United States Patent
Das et al.

(10) Patent No.: US 11,220,711 B2
(45) Date of Patent: Jan. 11, 2022

(54) COMPOSITIONS FOR CHARACTERIZING DEVELOPMENT OF ESOPHAGEAL ADENOCARCINOMA IN PATIENTS AND METHODS OF USE THEREOF

(71) Applicant: Rutgers, The State University of New Jersey, New Brunswick, NJ (US)

(72) Inventors: Kiron Das, Basking Ridge, NJ (US); Manisha Bajpai, Hillsborough, NJ (US); Hana Aviv, New Brunswick, NJ (US)

(73) Assignee: RUTGERS, THE STATE UNIVERSITY OF NEW JERSEY, New Brunswick, NJ (US)

( * ) Notice: Subject to any disclaimer, the term of this patent is extended or adjusted under 35 U.S.C. 154(b) by 186 days.

(21) Appl. No.: 16/083,055

(22) PCT Filed: Mar. 8, 2017

(86) PCT No.: PCT/US2017/021405
§ 371 (c)(1),
(2) Date: Sep. 7, 2018

(87) PCT Pub. No.: WO2017/156154
PCT Pub. Date: Sep. 14, 2017

(65) Prior Publication Data
US 2019/0100803 A1    Apr. 4, 2019

Related U.S. Application Data

(60) Provisional application No. 62/305,194, filed on Mar. 8, 2016.

(51) Int. Cl.
| | | |
|---|---|---|
| *C12Q 1/68* | (2018.01) | |
| *C12P 19/34* | (2006.01) | |
| *C12Q 1/6883* | (2018.01) | |
| *G01N 33/573* | (2006.01) | |
| *G01N 33/53* | (2006.01) | |
| *G01N 33/574* | (2006.01) | |
| *C12Q 1/6837* | (2018.01) | |

(52) U.S. Cl.
CPC ............ *C12Q 1/6883* (2013.01); *C12Q 1/68* (2013.01); *C12Q 1/6837* (2013.01); *G01N 33/53* (2013.01); *G01N 33/573* (2013.01); *G01N 33/574* (2013.01); *C12Q 2600/112* (2013.01); *C12Q 2600/156* (2013.01); *C12Q 2600/16* (2013.01)

(58) Field of Classification Search
CPC .. C12Q 1/6883; C12Q 1/68; C12Q 2600/112; G01N 33/574
See application file for complete search history.

(56) References Cited

U.S. PATENT DOCUMENTS

| | | |
|---|---|---|
| 6,812,339 B1 | 11/2004 | Venter et al. |
| 2004/0152125 A1 | 8/2004 | Presnell et al. |
| 2009/0226933 A1 | 9/2009 | Albitar et al. |

FOREIGN PATENT DOCUMENTS

WO    2014071419 A2    5/2014

OTHER PUBLICATIONS

Jin, Y. et al, "Cytogenetic and fluorescence in situ hybridization characterization of clonal chromosomal aberrations and CCND1 amplification in esophageal carcinomas" Cancer Genetics and Cytogenetics 148 (2004) 21-28 (Year: 2004).*
Liu, F. et al. "Dissecting the mechanism of colorectal tumorigenesis based on RNA-sequencing data" Experimental and Molecular Pathology. vol. 98, Issue 2, Apr. 2015, pp. 246-253 (available online Jan. 7, 2015) (Year: 2015).*
International Search Report and Written Opinion dated Apr. 6, 2018, issued by the U.S. Patent and Trademark Office in International Application No. PCT/US17/021405 (22 pages).
Bajpai, Manisha et al., "Prolonged exposures to acid and bile induces chromosome abnormalities that precede malignant transformation of benign Barrett's epithelium", Molecular Cytogenetics, pp. 1-8 (2012), http://www.molecularcytogenetics.org/content/5/1/43.

* cited by examiner

Primary Examiner — Stephen T Kapushoc
(74) Attorney, Agent, or Firm — Greenberg Traurig, LLP

(57) ABSTRACT

The present invention is a method, comprising: obtaining a sample of an esophageal tissue from a subject, wherein the sample of the esophageal tissue comprises or is suspected of comprising a break of chromosome 2 (chr2), a break of chromosome 10 (chr10), a break of chromosome 16 (chr16), or any combination thereof, and detecting in the sample of esophageal tissue whether the break of chr2 is present, whether the break of chr10 is present, whether the break of chr16 is present, or any combination thereof, by contacting the sample of esophageal tissue with a first detectably labeled probe, a second detectably labeled probe, a third detectably labeled probe, or any combination thereof, and detecting binding between: the first detectably labeled probe and the break of chr2, the second detectably labeled probe and the break of chr10, the third detectably labeled probe and the break of chr16, or any combination thereof.

8 Claims, 5 Drawing Sheets

Specification includes a Sequence Listing.

Das K.M. et.al., Int. J. Cancer: 128, 274-282 (2011)

Bajpai M, et.al., Lab Invest: 88:643-51 (2008)

ional Application No. PCT/US2017/021405 filed Mar. 8, 2017, which claims priority to U.S. Provisional Application Ser. No. 62/305,194, filed on Mar. 8, 2016, entitled "COMPOSITIONS FOR CHARACTERIZING DEVELOPMENT OF ESOPHAGEAL ADENOCARCINOMA IN PATIENTS AND METHODS OF USE THEREOF", the entire content of each of which is hereby incorporated by reference in its entirety.

COMPOSITIONS FOR CHARACTERIZING DEVELOPMENT OF ESOPHAGEAL ADENOCARCINOMA IN PATIENTS AND METHODS OF USE THEREOF

CROSS REFERENCE TO RELATED APPLICATION

This application claims priority to International Application No. PCT/US2017/021405 filed Mar. 8, 2017, which claims priority to U.S. Provisional Application Ser. No. 62/305,194, filed on Mar. 8, 2016, entitled "COMPOSITIONS FOR CHARACTERIZING DEVELOPMENT OF ESOPHAGEAL ADENOCARCINOMA IN PATIENTS AND METHODS OF USE THEREOF", the entire content of each of which is hereby incorporated by reference in its entirety.

FIELD OF THE INVENTION

The field of invention relates to compositions for characterizing development of esophageal adenocarcinoma in a patient.

BACKGROUND

Chronic regurgitation of highly acidic stomach fluids into the esophagus results in development of a specialized tissue called Barrett's epithelium (BE) at the distal segment of the esophagus and at the junction of esophagus and stomach. BE is known to progress to a morbid cancer known as Esophageal adenocarcinoma (EA). Within 5 years of diagnosis, 90% of the patients die from EA. Patients with BE are at a 120 fold higher risk of developing EA in a slow progression of disease from BE to low grade dysplasia, from low grade dysplasia to high grade dysplasia, and ultimately from high grade dysplasia into EA over several years. Slow progression of the disease allows time for medical intervention to prevent or slow down cancer development.

SUMMARY OF THE INVENTION

In some embodiments, the present invention provides a method, comprising:
 (a) obtaining a sample of an esophageal tissue from a subject,
 wherein the sample of the esophageal tissue comprises or is suspected of comprising a first translocation, a second translocation, a third translocation, or any combination thereof,
 wherein
  (i) the first translocation comprises a break of chromosome 2 (chr2) and a fusion of the break of chr2 with chromosome 10 (chr10),
  (ii) the second translocation comprises a break of chr10 and a fusion of the break of chr10 with chromosome 16 (chr16), and
  (iii) the third translocation comprises a break of chr16 and a fusion of the break of chr16 with chr2; and
 (b) detecting in the sample of esophageal tissue whether the first translocation is present, whether the second translocation is present, whether the third translocation is present, or any combination thereof, by contacting the sample of esophageal tissue with a first detectably labeled probe, a second detectably labeled probe, a third detectably labeled probe, or any combination thereof, and detecting binding between:
  (i) the first detectably labeled probe and the first translocation,
  (ii) the second detectably labeled probe and the second translocation,
  (iii) the third detectably labeled probe and the third translocation, or
  (iv) any combination thereof.

In some embodiments, the method further comprises: (c) diagnosing the subject with a predisposition for esophageal adenocarcinoma (EA) or EA when the presence of the first translocation, the second translocation, the third translocation, or any combination thereof, is detected.

In some embodiments, the sample of the esophageal tissue comprises or is suspected of comprising the first translocation, the second translocation, the third translocation, or any combination thereof.

In some embodiments, the present invention provides a method, comprising:
 (a) obtaining a sample of an esophageal tissue from a subject, wherein the sample of the esophageal tissue comprises or is suspected of comprising a break of chromosome 2 (chr2), a break of chromosome 10 (chr10), a break of chromosome 16 (chr16), or any combination thereof, and
 (b) detecting in the sample of esophageal tissue whether the break of chr2 is present, whether the break of chr10 is present, whether the break of chr16 is present, or any combination thereof, by contacting the sample of esophageal tissue with a first detectably labeled probe, a second detectably labeled probe, a third detectably labeled probe, or any combination thereof, and detecting binding between:
  (i) the first detectably labeled probe and the break of chr2,
  (ii) the second detectably labeled probe and the break of chr10,
  (iii) the third detectably labeled probe and the break of chr16, or
  (iv) any combination thereof.

In some embodiments, the method further comprises: (c) diagnosing the subject with a predisposition for esophageal adenocarcinoma (EA) or EA when the presence of the break of chr2, the break of chr10, the break of chr16, or any combination thereof, is detected.

In some embodiments, the sample of the esophageal tissue comprises or is suspected of comprising the break of chr2, the break of chr10, the break of chr16, or any combination thereof.

In some embodiments, the sample of the esophageal tissue is fresh, frozen, or paraffin embedded.

In some embodiments, the first detectably labeled probe comprises SEQ ID:1, SEQ ID:2, or a combination thereof. In some embodiments, the second detectably labeled probe comprises SEQ ID:3, SEQ ID:4, SEQ ID:5, or any combination thereof. In some embodiments, the third detectably labeled probe comprises SEQ ID:6, SEQ ID:7, SEQ ID:8, or any combination thereof.

In some embodiments, the subject has gastroesophageal reflux disease. In some embodiments, the subject has Barrett's esophagus. In some embodiments, the subject has low grade dysplasia. In some embodiments, the subject has high grade dysplasia. In some embodiments, the subject has esophageal adenocarcinoma.

In some embodiments, the detecting is performed using a microscope or flow cytometry. In some embodiments, the detectably labeled probe is detectable by fluorescence.

In some embodiments, the present invention provides a composition, comprising a detectably labeled probe comprising SEQ ID:1, SEQ ID:2, SEQ ID:3, SEQ ID:4 SEQ ID:5, SEQ ID:6, SEQ ID:7, SEQ ID:8, or any combination thereof.

In some embodiments, the present invention provides a kit, comprising:
  (i) SEQ ID:1, SEQ ID:2, SEQ ID:3, SEQ ID:4, SEQ ID:5, SEQ ID:6, SEQ ID:7, SEQ ID:8, or any combination thereof, and
  (ii) instructions for performing an assay for detecting:
    (a) a first translocation, a second translocation, a third translocation, or any combination thereof, wherein
      (i) the first translocation comprises a break of chromosome 2 (chr2) and a fusion of the break of chr2 with chromosome 10 (chr10),
      (ii) the second translocation comprises a break of chr10 and a fusion of the break of chr10 with chromosome 16 (chr16), and
      (iii) the third translocation comprises a break of chr16 and a fusion of the break of chr16 with chr2; or
    (b) a break at chr2, a break at chr10, a break at chr16, or any combination thereof.

In some embodiments, the kit further comprises a negative control, wherein the negative control does not contain a chromosomal break.

In some embodiments, the kit further comprises a positive control, wherein the positive control has a break at chr2, a break at chr10, a break at chr16, or any combination thereof. In some embodiments, the kit further comprises a positive control, wherein the positive control has a first translocation, a second translocation, a third translocation, or any combination thereof, wherein
  (i) the first translocation comprises a break of chromosome 2 (chr2) and a fusion of the break of chr2 with chromosome 10 (chr10),
  (ii) the second translocation comprises a break of chr10 and a fusion of the break of chr10 with chromosome 16 (chr16), and
  (iii) the third translocation comprises a break of chr16 and a fusion of the break of chr16 with chr2.

BRIEF DESCRIPTION OF THE FIGURES

The present invention will be further explained with reference to the attached drawings, wherein like structures are referred to by like numerals throughout the several views. The drawings shown are not necessarily to scale, with emphasis instead generally being placed upon illustrating the principles of the present invention. Further, some features may be exaggerated to show details of particular components.

FIG. 2A shows a diagrammatic view of translocation events, FIG. 2B illustrates Fluorescent in-situ hybridization (FISH) signal from paraffin embedded tumor tissue; FIG. 2C shows an enhanced view of the FISH signal from FIG. 2B. FIGS. 2D and 2E show FISH performed with probes for breakpoints on transformed cells derived from the BEC model and carrying the translocations.

Figure 1:
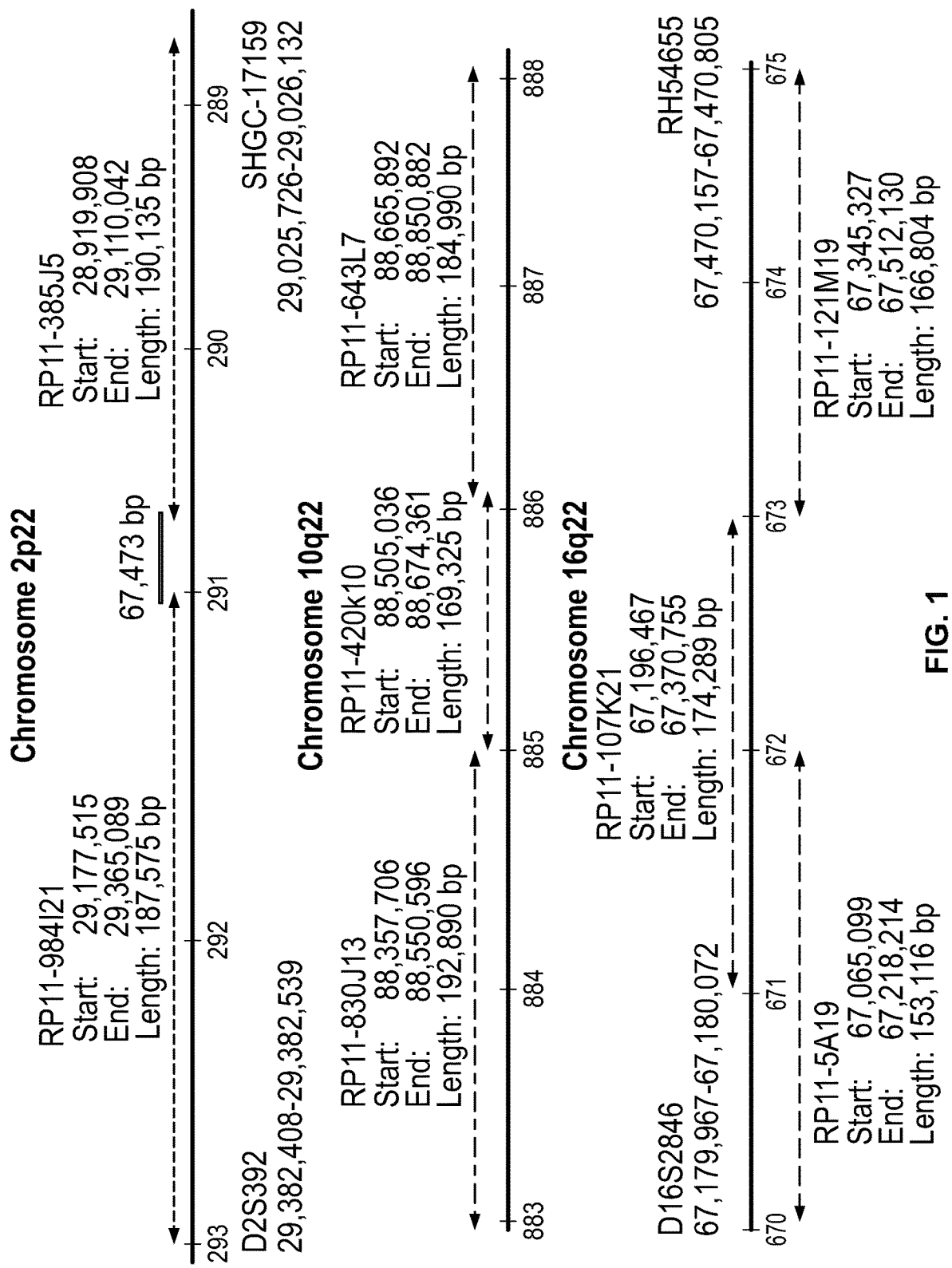
FIG. 1 shows a detailed map around the breakpoint of chromosomes 2, 10, and 16, which is used in some embodiments of the methods of the present invention.

The figures constitute a part of this specification and include illustrative embodiments of the present invention and illustrate various objects and features thereof. Further, the figures are not necessarily to scale, some features may be exaggerated to show details of particular components. In addition, any measurements, specifications and the like shown in the figures are intended to be illustrative, and not restrictive. Therefore, specific structural and functional details disclosed herein are not to be interpreted as limiting, but merely as a representative basis for teaching one skilled in the art to variously employ the present invention.

DETAILED DESCRIPTION

The present invention will be further explained with reference to the attached drawings, wherein like structures are referred to by like numerals throughout the several views. The drawings shown are not necessarily to scale, with emphasis instead generally being placed upon illustrating the principles of the present invention. Further, some features may be exaggerated to show details of particular components.

Among those benefits and improvements that have been disclosed, other objects and advantages of this invention will become apparent from the following description taken in conjunction with the accompanying figures. Detailed embodiments of the present invention are disclosed herein; however, it is to be understood that the disclosed embodiments are merely illustrative of the invention that may be embodied in various forms. In addition, each of the examples given in connection with the various embodiments of the invention which are intended to be illustrative, and not restrictive.

Each of the embodiments and aspects of the present disclosure can be practiced independently or combined. Also, the phraseology and terminology used herein is for the purpose of description and should not be regarded as limiting. The use of "including", "comprising", or "having", "containing", "involving", and variations thereof herein, is meant to encompass the items listed thereafter and equivalents thereof as well as additional items.

Throughout the specification and claims, the following terms take the meanings explicitly associated herein, unless the context clearly dictates otherwise. The phrases "in one embodiment" and "in some embodiments" as used herein do not necessarily refer to the same embodiment(s), though it may. Furthermore, the phrases "in another embodiment" and "in some other embodiments" as used herein do not necessarily refer to a different embodiment, although it may. Thus, as described below, various embodiments of the invention may be readily combined, without departing from the scope or spirit of the invention.

In addition, as used herein, the term "or" is an inclusive "or" operator, and is equivalent to the term "and/or," unless the context clearly dictates otherwise. The term "based on" is not exclusive and allows for being based on additional factors not described, unless the context clearly dictates otherwise. In addition, throughout the specification, the meaning of "a," "an," and "the" include plural references. The meaning of "in" includes "in" and "on."

Method of Detection

As used herein, a "break apart probe" or "detectably labeled probe" (e.g., a first detectably labeled probe, a second detectably labeled probe, a third detectably labeled probe, etc.) refers to a DNA probe designed to detect the translocation between segments of chromosomes. Break apart probes can bind to the same chromosome pair in at least two locations, and, when a translocation occurs the probe not only remains on the chromosome pair but is also detected on at least one separate chromosome. As a non-limiting example, the break apart probe (or "probe") for Chromosome 2 ("chr2") of the present invention includes two DNA segments. As a non-limiting example, the break apart probe (or "probe") for Chromosome 10 ("chr10") of the present invention includes two DNA segments. As another non-limiting example, the break apart probe (or "probe") for Chromosome 16 ("chr16") of the present invention includes two DNA segments. As another non-limiting example, since each chromosome of chr2, chr10, or chr16 comprises paired chromosomes, the break apart probe (set of two DNA segments) is configured to identify and bind to two locations; (e.g., one location for each of the pair of chromosomes in a normal pair of chromosomes) thus, when a translocation occurs and a segment of one of the chromosomes of the pair moves to another chromosome or to a different pair of chromosomes, the probe can bind to the separated segment of the broken chromosome.

As used herein, a "chromosomal break" or a "break" refers to a chromosomal abnormality in which a portion of a chromosome that has broken away and is no longer connected to the chromosome. In some embodiments, the size of the break is 50% of the chromosome or less (e.g., but not limited to, 40%, 30%, 20%, 10%, etc., of the full chromosome).

As used herein, "complementarity" refers to a relationship between two DNA sequences, such that when they are aligned antiparallel to each other, the nucleotide bases at each position in the sequences will be complementary (e.g., the reverse or "mirror-image"). The degree of complementarity between two nucleic acid strands may vary, from complete complementarity (e.g., each nucleotide is across from its opposite) to no complementarity (e.g., each nucleotide is not across from its opposite) and determines the stability of the sequences to be together.

As used herein, "fluorescence in situ hybridization" or "FISH" refers to a cytogenetic technique that uses at least one fluorescent probe (e.g., the detectably labeled probe comprising SEQ ID:1, SEQ ID:2, SEQ ID:3, SEQ ID:4 SEQ ID:5, SEQ ID:6, SEQ ID:7, SEQ ID:8, or any combination thereof) that binds to only those parts of the chromosome with a high degree of sequence complementarity.

As used herein, "flow cytometry" refers to a technology used to analyze the physical and chemical characteristics of particles in a fluid as it passes through at least one laser. Cell components (e.g., at least one chromosome) are fluorescently labelled and then excited by the laser to emit light at varying wavelengths.

As used herein, "fusion" or "fuse" refers to the process in which a portion of a chromosome breaks away from the chromosome and chemically attaches to a separate chromosome.

As used herein, the term "sample" refers to any composition containing or presumed to contain nucleic acid (DNA) from an individual. In the context of the present disclosure, a tissue biopsy may be used, including paraffin embedded tissues or tissues collected and preserved in the course of a pathologic or forensic investigation. Samples also may include constituents and components of esophageal cells or in vitro cultures of cells obtained from an individual.

As used herein, a "translocation" refers to a chromosome abnormality caused by rearrangement of parts between non-homologous chromosomes. Translocations can be balanced (e.g., in an even exchange of material with no genetic information extra or missing, and ideally full functionality) or unbalanced (e.g., where the exchange of chromosome material is unequal resulting in extra or missing genes. Translocations can be reciprocal (balanced or unbalanced) or nonreciprocal (balanced or unbalanced). Reciprocal translocations are typically an exchange of material between non-homologous chromosomes.

In some embodiments, the present invention provides a method, comprising:
  (a) obtaining a sample of an esophageal tissue from a subject,
  wherein the sample of the esophageal tissue comprises or is suspected of comprising a first translocation, a second translocation, a third translocation, or any combination thereof,
  wherein
    (i) the first translocation comprises a break of chromosome 2 (chr2) and a fusion of the break of chr2 with chromosome 10 (chr10),
    (ii) the second translocation comprises a break of chr10 and a fusion of the break of chr10 with chromosome 16 (chr16), and
    (iii) the third translocation comprises a break of chr16 and a fusion of the break of chr16 with chr2; and
  (b) detecting in the sample of esophageal tissue whether the first translocation is present, whether the second translocation is present, whether the third translocation is present, or any combination thereof, by contacting the sample of esophageal tissue with a first detectably labeled probe, a second detectably labeled probe, a third detectably labeled probe, or any combination thereof, and detecting binding between:
    (i) the first detectably labeled probe and the first translocation,
    (ii) the second detectably labeled probe and the second translocation,
    (iii) the third detectably labeled probe and the third translocation, or
    (iv) any combination thereof.

In some embodiments, the method further comprises: (c) diagnosing the subject with a predisposition for esophageal adenocarcinoma (EA) or EA when the presence of the first translocation, the second translocation, the third translocation, or any combination thereof, is detected.

In some embodiments, the sample of the esophageal tissue comprises or is suspected of comprising the first translocation, the second translocation, the third translocation, or any combination thereof.

In some embodiments, the present invention provides a method, comprising:
  (a) obtaining a sample of an esophageal tissue from a subject,
  wherein the sample of the esophageal tissue comprises or is suspected of comprising a break of chromosome 2 (chr2), a break of chromosome 10 (chr10), a break of chromosome 16 (chr16), or any combination thereof, and
  (b) detecting in the sample of esophageal tissue whether the break of chr2 is present, whether the break of chr10 is present, whether the break of chr16 is present, or any combination thereof, by contacting the sample of esophageal tissue with a first detectably labeled probe, a second detectably labeled probe, a third detectably labeled probe, or any combination thereof, and detecting binding between:
(i) the first detectably labeled probe and the break of chr2,
(ii) the second detectably labeled probe and the break of chr10,
(iii) the third detectably labeled probe and the break of chr16, or
(iv) any combination thereof.

In some embodiments, the method further comprises: (c) diagnosing the subject with a predisposition for esophageal adenocarcinoma (EA) or EA when the presence of the break of chr2, the break of chr10, the break of chr16, or any combination thereof, is detected.

In some embodiments, the sample of the esophageal tissue comprises or is suspected of comprising the break of chr2, the break of chr10, the break of chr16, or any combination thereof.

In some embodiments, the first detectably labeled probe comprises SEQ ID:1, SEQ ID:2, or a combination thereof. In some embodiments, the second detectably labeled probe comprises SEQ ID:3, SEQ ID:4, SEQ ID:5, or any combination thereof. In some embodiments, the third detectably labeled probe comprises SEQ ID:6, SEQ ID:7, SEQ ID:8, or any combination thereof.

In some embodiments, a first detectably labeled probe comprises chr2-RP11-385J5 (nucleotides 28919908-29110042) [SEQ ID:1] and/or chr2-RP11-984121 (nucleotides 29177515-29365089) [SEQ ID:2]. In some embodiments, a second detectably labeled probe comprises chr10-RP11-643L7 (nucleotides 88665892-88850882) [SEQ ID:3], chr10-RP11-420k10 (nucleotides 88505036-88674361) [SEQ ID:4], chr10-RP11-830J13 (nucleotides 88357706-88550596) [SEQ ID:5], or any combination thereof. In some embodiments, a third detectably labeled probe comprises chr16-RP11-107K21 (nucleotides 67196467-67370755) [SEQ ID:6], chr16-RP11-121M19 (nucleotides 67345327-67512130) [SEQ ID:7], chr16-RP11-5A19 (nucleotides 67065099-67218214) [SEQ ID:8], or any combination thereof.

In some embodiments, the detecting is performed using a microscope or flow cytometry. In some embodiments, the detectably labeled probe is detectable by fluorescence.

In some embodiments, the flow cytometry is performed as described in Rabinovitch et al., "Predictors of progression in Barrett's Esophagus III: Base line Flow Cytometric Variables" (2001) American Journal of Gastroenterology 96:11, which is incorporated by reference herein in its entirety.

In some embodiments, the flow cytometry is performed as described in Raponi et al., "An accurate and rapid flow cytometric diagnosis or BCR-ABL positive acute lymphoblastic leukemia" Haematologica (2009) 94(12): 1767-1770, which is incorporated by reference herein in its entirety.

In some embodiments, the detectably labeled probe is used in fluorescence in situ hybridization (FISH).

In some embodiments, the present invention is a method, comprising: (a) obtaining a sample of esophageal tissue suspected of comprising a first translocation, a second translocation, and a third translocation from the human subject, wherein the sample of the esophageal tissue comprises or is suspected of comprising the first translocation, the second translocation, and the third translocation, wherein the first translocation comprises a break of a short arm of chromosome 2 (chr2) and a fusion of the break of the short arm of chr2 with a long arm of chromosome 10 (chr10), the second translocation comprises a break of the long arm of chr10 and a fusion of the long arm of chr10 with a long arm of chromosome 16 (chr16), the third translocation comprises a break of a long arm of chr16 and a fusion of the long arm of chr16 with the short arm of chr2; (b) detecting the presence of the first translocation, the second translocation, and the third translocation in the sample of esophageal tissue, whereby the presence of the first translocation, the presence of the second translocation, and the presence of the third translocation in the sample of esophageal tissue is indicative of a predisposition to development of esophageal adenocarcinoma or presence of EA, wherein detecting the presence of the first translocation, the second translocation, and the third translocation is by application of a first detectably labeled probe, a second detectably labeled probe, and a third detectably labeled probe, where the first detectably labeled probe, the second detectably labeled probe, and the third detectably labeled probe each hybridize to the first translocation, the second translocation, and the third translocation and (c) characterizing the esophageal tissue as developing esophageal adenocarcinoma or not developing esophageal adenocarcinoma. In some embodiments, characterizing the esophageal tissue as developing esophageal adenocarcinoma includes identifying the first detectably labeled probe, the second detectably labeled probe, and the third detectably labeled probe each hybridizing to the first translocation, the second translocation, and the third translocation, so as to result in three positive hybridization results. In some embodiments, characterizing the esophageal tissue as not developing esophageal adenocarcinoma includes identifying the first detectably labeled probe, the second detectably labeled probe, and the third detectably labeled probe, where at least one of the first detectably labeled probe, the second detectably labeled probe, and the third detectably labeled probe does not hybridize to the first translocation, the second translocation, and/or the third translocation, so as to result in no positive hybridization results.

In some embodiments, the present invention is a method, comprising: (a) obtaining a sample of esophageal tissue suspected of comprising a first translocation and a second translocation from a human subject, wherein the sample of the esophageal tissue comprises or is suspected of comprising the first translocation and the second translocation, wherein the first translocation comprises a break of a short arm of chromosome 2 (chr2) and a fusion of chr2 with a long arm of chromosome 10 (chr10), the second translocation comprises a break of the long arm of chr10 and a fusion of chr10 with a short arm of chr2; (b) detecting the presence of the first translocation and the second translocation in the sample of esophageal tissue, whereby the presence of the first translocation and the presence of the second translocation in the sample of esophageal tissue is indicative of a predisposition to development of esophageal adenocarcinoma or presence of EA, wherein detecting the presence of the first translocation and the second translocation is by application of a first detectably labeled probe and a second detectably labeled probe, where the first detectably labeled probe and the second detectably labeled probe each hybridize to the first translocation and the second translocation, and (c) characterizing the esophageal tissue as developing esophageal adenocarcinoma or not developing esophageal adenocarcinoma. In some embodiments, characterizing the esophageal tissue as developing esophageal adenocarcinoma includes identifying the first detectably labeled probe and the second detectably labeled probe each hybridizing to the first translocation and the second translocation, so as to result in two positive hybridization results. In some embodiments, characterizing the esophageal tissue as not developing esophageal adenocarcinoma includes identifying the first detectably labeled probe and the second detectably labeled probe, where at least one of the first detectably labeled probe and the second detectably labeled probe does not hybridize to the first translocation and/or the second translocation, so as to result in no positive hybridization results.

In some embodiments, the present invention is a method, comprising: (a) obtaining a sample of esophageal tissue suspected of comprising a first translocation and a second translocation from the human subject, wherein the sample of the esophageal tissue comprises or is suspected of comprising the first translocation and the second translocation, wherein the first translocation comprises a break of a short arm of chromosome 2 (chr2) and a fusion of chr2 with a long arm of chromosome 16 (chr16) and the second translocation comprises a break of a long arm of chr16 and a fusion of the short arm of chr2; (b) detecting the presence of the first translocation and the second translocation in the sample of esophageal tissue, whereby the presence of the first translocation and the presence of the second translocation in the sample of esophageal tissue is indicative of a predisposition to development of esophageal adenocarcinoma or presence of EA, wherein detecting the presence of the first translocation and the second translocation is by application of a first detectably labeled probe and a second detectably labeled probe, where the first detectably labeled probe and the second detectably labeled probe each hybridize to the first translocation and the second translocation, and (c) characterizing the esophageal tissue as developing esophageal adenocarcinoma or not developing esophageal adenocarcinoma. In some embodiments, characterizing the esophageal tissue as developing esophageal adenocarcinoma includes identifying the first detectably labeled probe and the second detectably labeled probe each hybridizing to the first translocation and the second translocation, so as to result in two positive hybridization results. In some embodiments, characterizing the esophageal tissue as not developing esophageal adenocarcinoma includes identifying the first detectably labeled probe and the second detectably labeled probe, where at least one of the first detectably labeled probe and the second detectably labeled probe does not hybridize to the first translocation and/or the second translocation, so as to result in no positive hybridization results.

In some embodiments, the present invention is a method, comprising: (a) obtaining a sample of esophageal tissue suspected of comprising a first translocation, a second translocation, and a third translocation from the human subject, wherein the sample of the esophageal tissue comprises or is suspected of comprising the first translocation, the second translocation, and the third translocation, wherein the first translocation comprises a break of a long arm of chr10 and a fusion of chr10 with a long arm of chromosome 16 (chr16), the second translocation comprises a break of a long arm of chr16 and a fusion of long arm of chr10; (b) detecting the presence of the first translocation and the second translocation in the sample of esophageal tissue, whereby the presence of the first translocation and the presence of the second translocation in the sample of esophageal tissue is indicative of a predisposition to development of esophageal adenocarcinoma or presence of EA, wherein detecting the presence of the first translocation and the second translocation is by application of a first detectably labeled probe and a second detectably labeled probe, where the first detectably labeled probe and the second detectably labeled probe each hybridize to the first translocation and the second translocation and (c) characterizing the esophageal tissue as developing esophageal adenocarcinoma or not developing esophageal adenocarcinoma. In some embodiments, characterizing the esophageal tissue as developing esophageal adenocarcinoma includes identifying the first detectably labeled probe and the second detectably labeled probe each hybridizing to the first translocation comprising a break of the first chromosome and the second translocation, comprising a break of the first chromosome so as to result in three positive hybridization results, wherein a third positive hybridization result is identified as the break and the break may remain separate from all chromosomes or fuze with a new chromosome. In some embodiments, characterizing the esophageal tissue as not developing esophageal adenocarcinoma includes identifying the first detectably labeled probe and the second detectably labeled probe, where at least one of the first detectably labeled probe and the second detectably labeled probe hybridize to the complementary sequences on the chromosomes and lead to only two positive hybridization signals per probe.

In some embodiments, a first detectably labeled probe comprises chr2-RP11-385J5 (nucleotides 28919908-29110042) [SEQ ID:1], and chr2-RP11-984121 (nucleotides 29177515-29365089) [SEQ ID:2]. In some embodiments, a second detectably labeled probe comprises chr10-RP11-643L7 (nucleotides 88665892-88850882) [SEQ ID:3], chr10-RP11-420k10 (nucleotides 88505036-88674361) [SEQ ID:4], and chr10-RP11-830J13 (nucleotides 88357706-88550596) [SEQ ID:5]. In some embodiments, a third detectably labeled probe comprises chr16-RP11107K21 (nucleotides 67196467-67370755) [SEQ ID:6], chr16-RP11-121M19 (nucleotides 67345327-67512130) [SEQ ID:7], and chr16-RP11-5A19 (nucleotides 67065099-67218214) [SEQ ID:8].

In some embodiments, characterizing the esophageal tissue as developing esophageal adenocarcinoma can refer to an increase in a subject's likelihood of developing esophageal adenocarcinoma, where the increase can range from, e.g., but not limited to, between 10%-100% (e.g., but not limited to, 10%, 20%, 30%, 40%, 50%, 60%, 70%, 80%, 90%, 100%) when compared with a normal sample (e.g., but not limited to, a sample of esophageal tissue retrieved from a patient not diagnosed with BE).

In some embodiments, the increase in the likelihood of developing esophageal adenocarcinoma can be between 10-90% when compared with a normal sample (e.g., but not limited to, a sample of esophageal tissue retrieved from a patient not diagnosed with BE). In some embodiments, the increase in the likelihood of developing esophageal adenocarcinoma can be between 10-80% when compared with a normal sample (e.g., but not limited to, a sample of esophageal tissue retrieved from a patient not diagnosed with BE). In some embodiments, the increase in the likelihood of developing esophageal adenocarcinoma can be between 10-70% when compared with a normal sample (e.g., but not limited to, a sample of esophageal tissue retrieved from a patient not diagnosed with BE). In some embodiments, the increase in the likelihood of developing esophageal adenocarcinoma can be between 10-60% when compared with a normal sample (e.g., but not limited to, a sample of esophageal tissue retrieved from a patient not diagnosed with BE). In some embodiments, the increase in the likelihood of developing esophageal adenocarcinoma can be between 10-50% when compared with a normal sample (e.g., but not limited to, a sample of esophageal tissue retrieved from a patient not diagnosed with BE). In some embodiments, the increase in the likelihood of developing esophageal adenocarcinoma can be between 10-40% when compared with a normal sample (e.g., but not limited to, a sample of esophageal tissue retrieved from a patient not diagnosed with BE). In some embodiments, the increase in the likelihood of developing esophageal adenocarcinoma can be between 10-30% when compared with a normal sample (e.g., but not limited to, a sample of esophageal tissue retrieved from a patient not diagnosed with BE). In some embodiments, the increase in the likelihood of developing esophageal adenocarcinoma can be between 10-20% when compared with a normal sample (e.g., but not limited to, a sample of esophageal tissue retrieved from a patient not diagnosed with BE).

In some embodiments, the increase in the likelihood of developing esophageal adenocarcinoma can be between 20-100% when compared with a normal sample (e.g., but not limited to, a sample of esophageal tissue retrieved from a patient not diagnosed with BE). In some embodiments, the increase in the likelihood of developing esophageal adenocarcinoma can be between 30-100% when compared with a normal sample (e.g., but not limited to, a sample of esophageal tissue retrieved from a patient not diagnosed with BE). In some embodiments, the increase in the likelihood of developing esophageal adenocarcinoma can be between 40-100% when compared with a normal sample (e.g., but not limited to, a sample of esophageal tissue retrieved from a patient not diagnosed with BE). In some embodiments, the increase in the likelihood of developing esophageal adenocarcinoma can be between 50-100% when compared with a normal sample (e.g., but not limited to, a sample of esophageal tissue retrieved from a patient not diagnosed with BE). In some embodiments, the increase in the likelihood of developing esophageal adenocarcinoma can be between 60-100% when compared with a normal sample (e.g., but not limited to, a sample of esophageal tissue retrieved from a patient not diagnosed with BE). In some embodiments, the increase in the likelihood of developing esophageal adenocarcinoma can be between 70-100%. In some embodiments, the increase in the likelihood of developing esophageal adenocarcinoma can be between 80-100% when compared with a normal sample (e.g., but not limited to, a sample of esophageal tissue retrieved from a patient not diagnosed with BE). In some embodiments, the increase in the likelihood of developing esophageal adenocarcinoma can be between 90-100% when compared with a normal sample (e.g., but not limited to, a sample of esophageal tissue retrieved from a patient not diagnosed with BE).

In some embodiments, the increase in the likelihood of developing esophageal adenocarcinoma can be between 20-90% when compared with a normal sample (e.g., but not limited to, a sample of esophageal tissue retrieved from a patient not diagnosed with BE). In some embodiments, the increase in the likelihood of developing esophageal adenocarcinoma can be between 30-80% when compared with a normal sample (e.g., but not limited to, a sample of esophageal tissue retrieved from a patient not diagnosed with BE). In some embodiments, the increase in the likelihood of developing esophageal adenocarcinoma can be between 40-70% when compared with a normal sample (e.g., but not limited to, a sample of esophageal tissue retrieved from a patient not diagnosed with BE). In some embodiments, the increase in the likelihood of developing esophageal adenocarcinoma can be between 50-60% when compared with a normal sample (e.g., but not limited to, a sample of esophageal tissue retrieved from a patient not diagnosed with BE).

Tissue Obtained from a Human Subject

As used herein, "gastroesophageal reflux disease" refers to a digestive disorder that affects the lower esophageal sphincter, the ring of muscle between the esophagus and stomach, where the stomach's contents return into the esophagus.

As used herein, the term "esophageal adenocarcinoma" or "EA" refers to a disease state of a subject, in which the glandular cells present in the lower third of the esophagus, often where they have already transformed to intestinal cell type (a condition known as "Barrett's esophagus").

As used herein, "high grade dysplasia" refers to a subject diagnosed with Barrett's esophagus, where the subject has an increased risk of esophageal adenocarcinoma. High grade dysplasia means that some of the cells contained in the area of Barrett's esophagus look abnormal under the microscope. This is a more advanced pre-cancer of the esophagus than low-grade dysplasia. Subjects diagnosed with high grade dysplasia have a high risk of getting esophageal adenocarcinoma.

As used herein, "low grade dysplasia" refers to a subject diagnosed with Barrett's esophagus, where the subject has an increased risk of esophageal adenocarcinoma. Low-grade dysplasia means that some of the cells look abnormal when seen under the microscope. Subjects diagnosed with low grade dysplasia have an increased risk of getting esophageal adenocarcinoma compared to subjects not diagnosed with low grade dysplasia.

In some embodiments, esophageal tissue is obtained from a biopsy. In some embodiments, esophageal cells are obtained from a biopsy. In some embodiments, esophageal cells are obtained from a sponge biopsy.

In some embodiments, the subject has gastroesophageal reflux disease. In some embodiments, the subject has Barrett's esophagus. In some embodiments, the subject has low grade dysplasia. In some embodiments, the subject has high grade dysplasia. In some embodiments, the subject has esophageal adenocarcinoma.

In some embodiments, the sample of the esophageal tissue is fresh, frozen, or paraffin embedded. In some embodiments, the esophageal tissue can be frozen using liquid nitrogen using standard techniques and then embedded in optimal compound (OCT) compound for making sections (e.g., but not limited to, 5 micron tissue sections) for FISH. In some embodiments, tissue can be fixed in formalin and then embedded in paraffin wax.

Composition for Detecting a Translocation or a Chromosomal Break

In some embodiments, the present invention provides a composition, comprising a detectably labeled probe comprising SEQ ID:1, SEQ ID:2, SEQ ID:3, SEQ ID:4 SEQ ID:5, SEQ ID:6, SEQ ID:7, SEQ ID:8, or any combination thereof.

In some embodiments, a detectably labeled probe comprises chr2-RP11-385J5 (nucleotides 28919908-29110042) [SEQ ID:1], chr2-RP11-984121 (nucleotides 29177515-29365089) [SEQ ID:2], chr10-RP11-643L7 (nucleotides 88665892-88850882) [SEQ ID:3], chr10-RP11-420k10 (nucleotides 88505036-88674361) [SEQ ID:4], chr10-RP11-830J13 (nucleotides 88357706-88550596) [SEQ ID:5], chr16-RP11-107K21 (nucleotides 67196467-67370755) [SEQ ID:6], chr16-RP11-121M19 (nucleotides 67345327-67512130) [SEQ ID:7], chr16-RP11-5A19 (nucleotides 67065099-67218214) [SEQ ID:8], or any combination thereof.

In some embodiments, the detectably labeled probe can be artificially modified to have a detectable label or dye attached thereto and hence is non-naturally occurring. The probe can contain a sequence selected from SEQ ID NO: 1, SEQ ID NO: 2, SEQ ID NO: 3, SEQ ID NO: 4, SEQ ID NO:5 SEQ ID NO:6, SEQ ID NO: 7, and/or SEQ ID NO:8. The detectable label or dye can be covalently, non-covalently, directly, or indirectly attached to the probe. The label can be fluorescent or non-fluorescent (e.g., haptens such as Biotin and Digoxigenin). Commonly used fluorescent labels are Orange 5-TAMRA dUTP, Green 5-Flluorescein dUTP, Red 5-ROX dUTP, and Aqua DY-415 dUTP, These fluorescent labels can be directly detected via, e.g., fluorescence spectroscopy. The DNA probe is labeled by various means, such as, but not limited to, nick translation, random primed labeling, and PCR. Two labeling strategies are commonly used: indirect labeling and direct labeling. For indirect labeling, probes are labeled with modified nucleotides that contain a hapten, whereas direct labeling uses nucleotides that have been directly modified to contain a fluorophore. If the probe has been labeled indirectly, an extra step is required for visualization of the non-fluorescent hapten that uses an enzymatic or immunological detection system, which are known in the art.

In some embodiments, the detectably labeled probe is labeled with a fluorescent label. In some embodiments, the fluorescent label comprises: Orange 5-TAMRA dUTP, Green 5-Flluorescein dUTP, Red 5-ROX dUTP, Aqua DY-415 dUTP, Gold 5-carboxyrhodamine 6G dUTP, or any combination thereof.

In some embodiments, the detectably labeled probe is a fragment of DNA of variable length which can be used to detect the presence and/or location of a DNA target (e.g., a chromosome) that has complementary to the sequence in the detectably labeled probe. In some embodiments, the detectably labeled probe hybridizes to the DNA whose base sequence allows for base pairing due to complementarity between the probe and DNA target. In some embodiments, the DNA target is chr2, chr10, chr16, or any combination thereof.

Kit for Detecting a Translocation or a Chromosomal Break

In some embodiments, the present invention provides a kit, comprising:
(i) SEQ ID:1, SEQ ID:2, SEQ ID:3, SEQ ID:4, SEQ ID:5, SEQ ID:6, SEQ ID:7, SEQ ID:8, or any combination thereof, and
(ii) instructions for performing an assay for detecting:
  (a) a first translocation, a second translocation, a third translocation, or any combination thereof, wherein
    (i) the first translocation comprises a break of chromosome 2 (chr2) and a fusion of the break of chr2 with chromosome 10 (chr10),
    (ii) the second translocation comprises a break of chr10 and a fusion of the break of chr10 with chromosome 16 (chr16), and
    (iii) the third translocation comprises a break of chr16 and a fusion of the break of chr16 with chr2; or
  (b) a break at chr2, a break at chr10, a break at chr16, or any combination thereof.

In some embodiments, the kit further comprises a negative control, wherein the negative control does not contain a chromosomal break. In some embodiments, the kit further comprises a negative control, wherein the negative control does not contain a translocation (e.g., a first translocation, a second translocation, a third translocation, or any combination thereof).

In some embodiments, the kit further comprises a positive control, wherein the positive control has a break at chr2, a break at chr10, a break at chr16, or any combination thereof. In some embodiments, the kit further comprises a positive control, wherein the positive control has a first translocation, a second translocation, a third translocation, or any combination thereof, wherein
  (i) the first translocation comprises a break of chromosome 2 (chr2) and a fusion of the break of chr2 with chromosome 10 (chr10),
  (ii) the second translocation comprises a break of chr10 and a fusion of the break of chr10 with chromosome 16 (chr16), and
  (iii) the third translocation comprises a break of chr16 and a fusion of the break of chr16 with chr2.

In some embodiments, the present invention is a kit which provides a first detectably labeled probe (e.g., but not limited to, SEQ ID:1 and SEQ ID:2), a second detectably labeled probe (e.g., but not limited to, SEQ ID:3, SEQ ID:4, and SEQ ID:5), and a third detectably labeled probe (e.g., but not limited to, SEQ ID:6, SEQ ID:7, and SEQ ID:8), or any combination thereof.

Example: Barrett's Epithelium Carcinogenesis

In an exemplary embodiment, the present invention is a method for characterizing three translocation events involving segments of three human chromosomes (chromosomes 2, 10, and 16) in a disease model of Barrett's epithelium carcinogenesis (BEC). As the BEC model demonstrates, progressive events eventually leading to malignant transformation of hTERT immortalized benign metaplastic BE cells, BAR-T as a result of 5 min/day exposure to acidified (pH4) bile salt, GCDC (Glycocheno-deoxycholic acid, physiological component of gastric refluxate) for 60 weeks (BEC60W). The three-way translocation (chromosomes 2, 10, and 16) was reliably reproduced in replicates of the BEC model and appeared around BEC30W almost 30 weeks before the cells become transformed. This translocation event can be described cytogenetically as t(2;10;16) (p22, q22,q22), and involved break of short arm of chr 2 and fusion with long arm of chr10, break of long arm of chr10 and its fusion with long arm of chr16, break of long arm of chr 16 and fusion with short arm of chr2 (see, e.g., FIG. 2A).

Figure 2A:
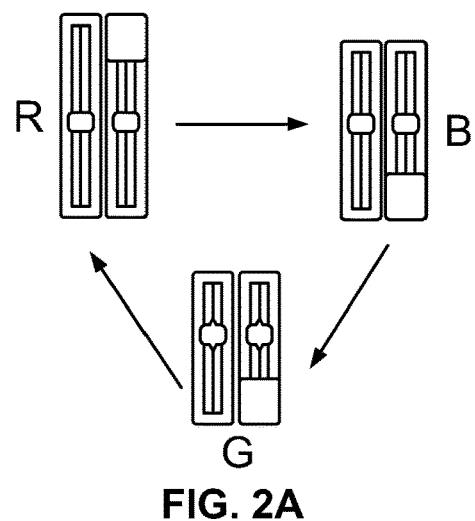
FIGS. 2A-D shows embodiments of the method of the present invention, where
Figure 2B:
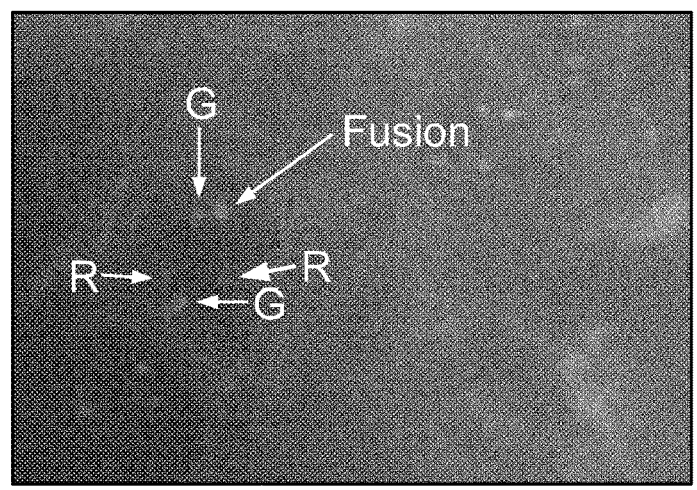
Figure 2C:
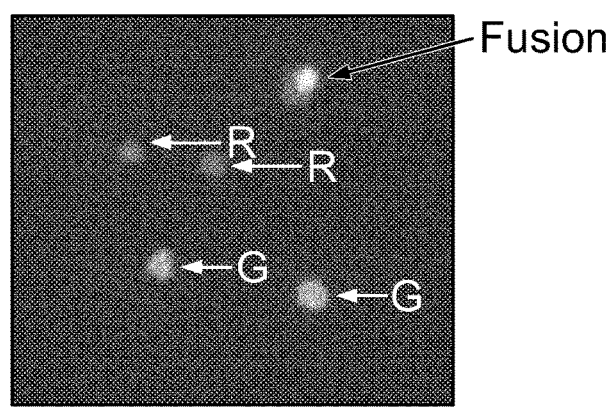
Figure 2D:
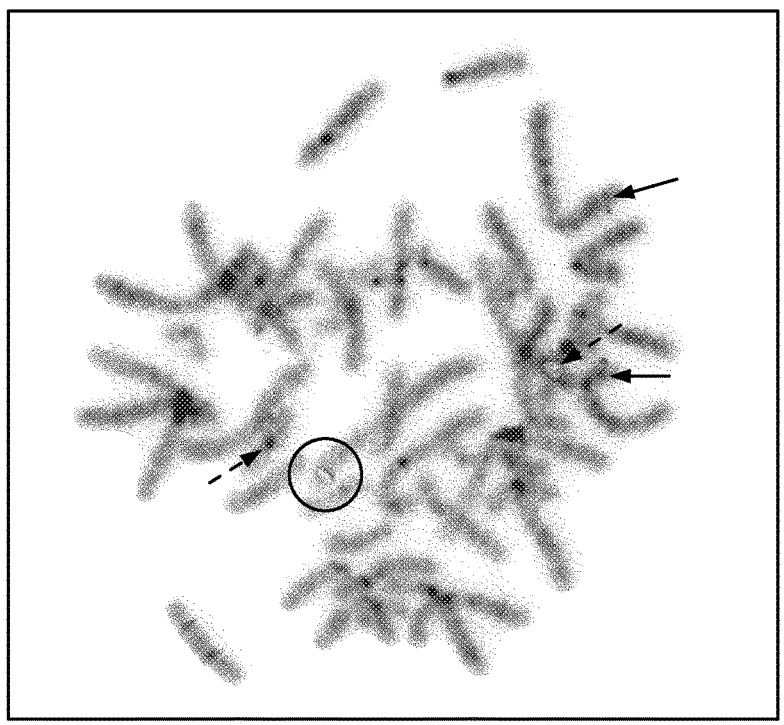
Figure 2E:
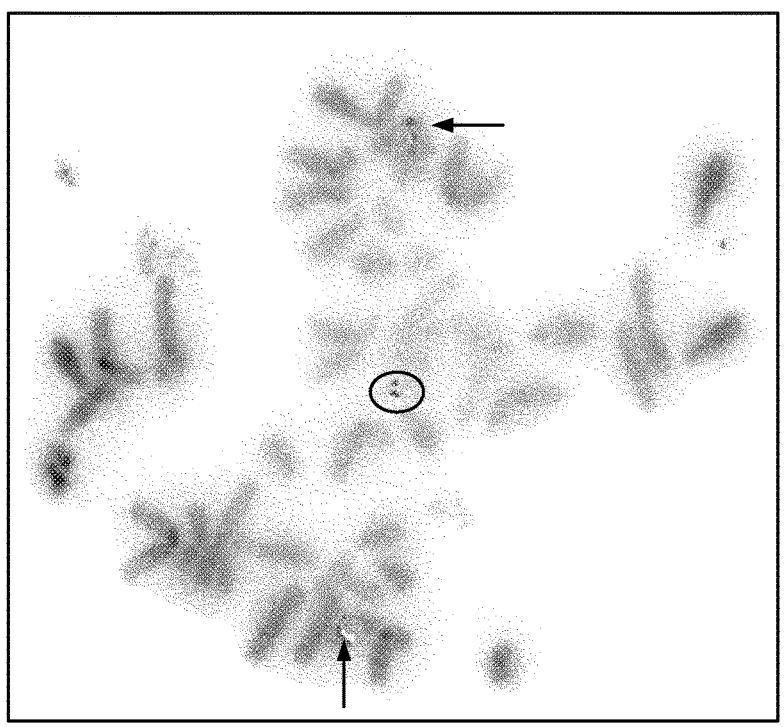

FIG. 2A shows an embodiment of the method of the present invention, showing a diagrammatic view of the translocation events involving breakage and exchange of three chromosome segments t(2; 10; 16) (p22,q22,q22). Chr 2 is red ("R"), chr10 is blue ("B") and chr16 is green ("G"). FIG. 2B shows an embodiment of the method of the present invention, illustrating the Fluorescent in-situ hybridization (i.e., "FISH") signal from paraffin embedded EA tumor tissue using green ("G") color probe for chr16 and red ("R") for chr2 breakpoints. Figure C shows an embodiment of the method of the present invention, showing an enhanced view of the FISH signal from FIG. 2B and illustrating the fusion of red and green signals in the fifth yellowish dot ("fusion"). This fusion signal proves the presence of the unique translocation event involving chr2 and 16 in the EA tissue. The two red signals are one each from the unbroken homologous chr 2 and the remaining part of the broken chr 2. The two green signals are from the homologous chr 16 and the remaining part of the broken chr16. FIGS. 2D and 2E show FISH performed with probes for chr2 and chr10 breakpoints on BEC40W and BEC60W cells. FIG. 2D shows a break apart probe spanning the translocation breakpoint on chr 2 (solid arrow) and relocation of this probe to chr 10 due to a translocation (dotted arrow, bottom). A break apart probe localizes to the translocation breakpoint on chr 16 (dotted arrows). The fusion of the break segment of chr 16 on chr 2 is circled. FIG. 2E shows a break apart probe on two copies of chr10, marked by two arrows, the fusion of segments of chr2 and chr10 is depicted by a circle.

In some embodiments, the method of the present invention includes using DNA probes for chr 2, 10, and 16 breakpoints for identifying the 3-way translocation (i.e., chr2, chr10, and chr16) in EA tissues. Table 1 shows exemplary tissues tested for a presence of at least one chromosomal fusion.

TABLE 1

EA Tissues Tested:

| Case No. | Pathology Report | Pathology Status | Specimen Preparation Type | QC Result | FISH result |
|---|---|---|---|---|---|
| TISSUES STUDIED | | | | | |
| 8561 | moderately differentiated adenocarcinoma intestinal type with invasion through entire thickness of muscalaris propria | Tumor | Frozen Tissue | Good | positive for fusion |
| 7473 | moderately differentiated adenocarcinoma arising in barrets metaplasia | Tumor | Frozen Tissue | Good | positive for fusion |
| 8268 | moderatelly-differentiated adenocarcinoma of esophagus, arising in a tubulovillous adenoma, in a setting of barrets esophagus | Tumor | Frozen Tissue | Good | positive for fusion |
| 3257 | invasive mod diff mucinous adenocarcinoma | Tumor | Frozen Tissue | Good | positive for fusion |
| TISSUES BEING STUDIED | | | | | expected result |
| 3506 | infiltrating mod diff adenocarcinoma of the gastroesophageal | Tumor | Frozen Tissue | Good | positive for fusion |
| 3928 | poorly diff adenocarcinoma | Tumor | Frozen Tissue | Good | positive for fusion |
| 4449 | invasive mod to poorly diff adenocarcinoma | Tumor | Frozen Tissue | Good | positive for fusion |
| 5634 | moderate to poor focally differentiated invasive adenocarcinoma | Tumor | Frozen Tissue | Good | positive for fusion |
| 7668 | moderately differentiated adenocarcinoma intestinal type, arising in a background of barrets esophagus | Tumor | Frozen Tissue | Good | positive for fusion |
| 3190 | adenocarcinoma mod diff | Tumor | Frozen Tissue | | positive for fusion |
| 3289 | poorly diff adenocarcinoma | Tumor | Frozen Tissue | | positive for fusion |
| 8561 | moderately differentiated adenocarcinoma intestinal type with invasion through entire thickness of muscalaris propria | Normal area surrounding tumor | Frozen Tissue | Good | no fusion signal |
| 7473 | moderately differentiated adenocarcinoma arising in barrets metaplasia | Normal area surrounding tumor | Frozen Tissue | Good | no fusion signal |
| 8268 | moderatelly-differentiated adenocarcinoma of esophagus, arising in a tubulovillous adenoma, in a setting of barrets esophagus | Normal area surrounding tumor | Frozen Tissue | Good | no fusion signal |
| 3257 | invasive mod diff mucinous adenocarcinoma | Normal area surrounding tumor | Frozen Tissue | Good | no fusion signal |

TABLE 1-continued

EA Tissues Tested:

| Case No. | Pathology Report | Pathology Status | Specimen Preparation Type | QC Result | FISH result |
|---|---|---|---|---|---|
| 3506 | infiltrating mod diff adenocarcinoma of the gastroesophageal | Normal area surrounding tumor | Frozen Tissue | Good | no fusion signal |
| 3928 | poorly diff adenocarcinoma | Normal area surrounding tumor | Frozen Tissue | Good | no fusion signal |
| 4449 | invasive mod to poorly diff adenocarcinoma | Normal area surrounding tumor | Frozen Tissue | Good | no fusion signal |
| 5634 | moderate to poor focally differentiated invasive adenocarcinoma | Normal area surrounding tumor | Frozen Tissue | Good | no fusion signal |
| 7668 | moderately differentiated adenocarcinoma intestinal type, arising in a background of barrets esophagus | Normal area surrounding tumor | Frozen Tissue | Good | no fusion signal |
| 3190 | adenocarcinoma mod diff | Normal area surrounding tumor | Frozen Tissue | | no fusion signal |
| 3289 | poorly diff adenocarcinoma | Normal area surrounding tumor | Frozen Tissue | | no fusion signal |

In some embodiments, Bajpai et al. Molecular Cytogenetics 2012, 5:43 discloses methods which may be used in the present invention, and its entire content is hereby incorporated by reference in its entirety.

Methods:

Cell Culture:

BAR-T is an hTERT immortalized cell line derived from a biopsy of benign Barrett's epithelium (methods disclosed in in Jaiswal K R et al., "Characterization of telomerase-immortalized, non-neoplastic, human Barrett's cell line (BAR-T)" Dis Esophagus. 2007; 20(3):256-64, which is hereby incorporated by reference in its entirety) and the different BEC cells are derived from it after B4 exposure, therefore grows in special supplemented keratinocyte medium (KBM2) from Cambrex Bioscience (East Rutherford, N.J., USA) with 5% fetal bovine serum (FBS) containing 1% penicillin/streptomycin. Cells were kept in a humidified incubator with 5% CO2 at 37° C. The bile acid, glycochenodeoxycholic acid, GCDA (Sigma, St. Louis, Mich., USA), was diluted to optimum working concentration of 200 µM and Hydrochloric acid was used to adjust the pH to pH4 (B4). 0.1×10$^6$ cells growing on six-well plates were incubated in B4 for 5 min every day and the cells were then returned to normal KBM2 medium in the incubator. No treatment was done on the day the cells were passed. 5 min was sufficient for induction of signal transduction pathways regulating cellular machinery without cell damage. The control untreated cells were grown in parallel in the KBM2 medium at pH7.4. For chronic exposure, cells were exposed for 5 min every day to B4 for up to 80 weeks and are referred to as BEC0W for parent cells (or BAR-T), BEC20W, BEC30W or BEC60W for 20, 30 or 60 weeks of B4 exposure respectively. These cells were frozen in liquid Nitrogen at different time points and can be revived for additional experiments. The cells were successfully recovered from storage and found to reproduce the transcriptional and chromosomal changes observed in the BEC model at distinct time points. As a non-limiting example, FIG. 3 illustrates this process.

Figure 3:
FIG. 3 shows embodiments of the method of the present invention, showing the time line of changes in the Barrett's epithelial carcinogenesis (BEC) model.

FIG. 3 shows the time line of changes in the Barrett's epithelial carcinogenesis model. Prolonged acid and bile exposure induces a cascade of changes in the BAR-T cells. Induction of colonic phenotype at 2 weeks, genetic and epigenetic changes at about 20 weeks, change in cell shape at 40 weeks, growth in soft agar reminiscent of transformation at 60 weeks and tumor formation in mice at 80 weeks. The chromosomal break and fusion events occur around 30 weeks of acid and bile exposure.

Fluorescent In-Situ Hybridization (FISH)

FISH probes were developed which span the breakpoints on 10q22, 16q22, and 2p22 (e.g., the location is shown in FIG. 1) and each of the three probes (e.g., but not limited to: the probe of chromosome 2 including SEQ IDs:1-2, the probe of chromosome 10 including SEQ IDs: 3-5, and the probe of chromosome 16 including SEQ IDs: 6-8) were confirmed for specificity after comparing the BEC40W and BEC60W cells that carry the translocations to naïve BAR-T cells (i.e., BAR-T cells which have not been previously exposed to acid, e.g., acids at pH4, and/or bile) that do not have this event. For FISH, paraffin embedded tissue slides were first de-paraffinization by placing for 5 min on Hybrite (Vysis) temperature and humidity controlled programmable slide processing system at 90° C. (to melt wax) and then immediately in Citrisolv (Fisher Scientific) and agitated for 10 min. The slides were then transferred to 100% EtOH in room temperature for 5 mins and allowed to air dry. The de-parrafinized slides underwent pre-treatment in 0.1N HCl for 20 min at room temperature followed by a brief rinse in water and 3 mins in wash buffer (2×SSC) followed by 30 mins in Pre-Treatment solution (1M NaSCN) at 80° C. After pretreatment, the slides underwent protease treatment for 1 hr followed by a rinse in 1×PBS (2 min) and then were fixed in Formaldehyde Solution for 5 min and rinsed in PBS again. The slides were then subjected to stepwise dehydration using series of 2 mins dips in 70, 80, 100% EtOH and air dry. The requisite amount of FISH probes were then placed on the tissue section on the slides, sealed, and incubated in the Hybrite. The Hybrite was programmed to denature for 3 mins at 83° C. and hybridize at 37° C. for 20 hours. Following hybridization, slides were washed in 0.4× SSC at 73° C. 3.0 min followed by 2×SSC/0.1% NP40, 30 sec and then stained with DAPI sealed with coverslip and observed under the Olympus BX41 fluorescence microscope or stored in −20° C. freezer. The frozen tissue embedded in optimal cutting temperature compound (OCT) is processed using the same methodology as described herein.

FIG. 1 shows a detailed map of the location of BAC clones around the breakpoint of chromosomes 2, 10, and 16.

Results:

Select BAC Clones can be Used as Specific FISH Probes for the Translocation Event(s) Seen in BEC Model.

The breakpoint on chr2p22 lies between DNA markers: D2S392 and D2S2934 (SHGC-17159) and is spanned by 2 BAC clones: RP11-100C1, and RP11-385J5 (all labeled Red). The breakpoint on chr10q22 is spanned by 3 BAC clones: RP11-1081F9 or RP11-830J13, RP11-420K10, RP11-643L7 (all on Chromosome 10q22). The breakpoint on chr16q22 between DNA markers: D1652846 and RH54655, and is spanned by BAC clones RP11-5A19, RP11-107K21, RP11-121M19 (all green). When the chromosome segments are exchanged, the probes split to the two signals on the different chromosomes as witnessed in FIGS. 2D and 2E. This exchange of segments between chromosomes results in new fusions (one such fusion is shown by yellow color in FIG. 2D chr2p22 and chr16q22)

FISH Probes Detect the Translocation Event in Clinical EA Tissues.

Unlike the metaphase chromosomes seen in cell preparations from cell lines, the tumor tissues mostly have cells in different stages of interphase. Thus the chromosomes are not visible as separate strands and are rather indistinct from each other. With the help of Olympus BX41 fluorescence microscope and meta-systems software, pictures of the probes reveal, break of the chr2 and 16 (represented by red and green dots, one for each pair of chromosomes) and the fusion between segments of chr2 and 16 appears as a yellow dot resulting from juxtaposition of red and green color probes (FIGS. 2B and C).

FISH Probes Detect a Chromosomal Break in Clinical EA Tissues.

Figure 4:
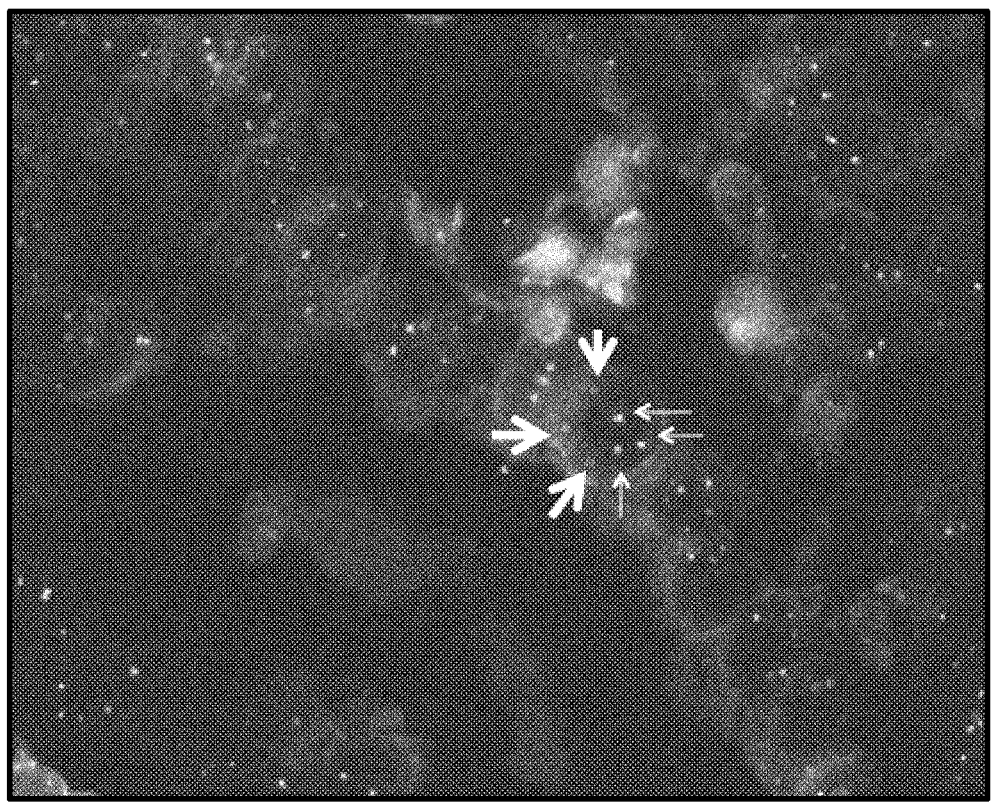
FIG. 4 shows an embodiment of the method of the present invention, where FISH signals are used to identify breaks in chromosomes.

Broken fragments of Chr 2 are shown using thick arrows pointing towards Chr2 fragments, and broken fragments of Chr16 are shown using thin arrows pointing towards Chr16 fragments. While the breakages of chr2 and chr16 occurred, no fusion of either Chr2 or Chr16 was not observed. (FIG. 4) The tumor tissue section was obtained from a resected human esophageal adenocarcinoma with poorly differentiated cells. FIG. 4 depicts a situation when the chr2 and chr16 are both broken to give show three labeled DNA but do not fuse, as yellow signal was not produced by juxtaposition of the red and green color.

While a number of embodiments of the present invention have been described, it is understood that these embodiments are illustrative only, and not restrictive, and that many modifications may become apparent to those of ordinary skill in the art. Further still, the various steps may be carried out in any desired order (and any desired steps may be added and/or any desired steps may be eliminated).

SEQUENCE LISTING (8 sequences)

SEQ ID NO: 1 - DNA, 190135 bp, Homo sapiens
tcacgtatgatctcacaattccactttggggtacatactcaaaagaattgaaagcaggatcccagagatatttgtacaccgacattcatagcagcattattcacaacagctaaaatgtgggaacaacccaagggttcatcaatagatggatgaacaaatatggtatatacggacaatggaatattcttcatattctttagcctcaaaaaggaaggaaactctgacacctgctattacatggatgagccttgaggacattatgctaaatgaaataagccagtcacaaaaggacaaatgctgtatgatttgactcacatgaggtacttacagccgccaaaatcatagacagaaagtagaatagtggtggccaggtattggggggaggggggaatggggagttattgcttaatgggtacagagtttcagtcgtacaagatgataagagttctggatggatggtggtgatagttgcacgacattatgaatgtatttaataccactaaactgtgcactttaaaatggttaagatggtaaattttatgtcatgtgtatcttgccacaatttaaaaaatggaaaaaaatgatctgattgaggaaagtttgacaagagagataaactgagtcacaagagctgcagctcaaaaacagcaatgagtaaatcacagccagatataagaagagaaccctcttggggaaaatgaccaaggcagggaggatctaggagaggaaactgatcattgtcaacattccctgctgagctcccactctgagcaaagaccatgcaaagcacagtggtggcacaaggccagctcttccttaagccttgccggtctctctacccccagtcagactccctgtcttaggggtttatctgtacctctcttattgaacataactttcccacttagtatctatgggatattgtgcaacttatttagctttcctgtgcattgttttcttttttccttttttagagatgggggcctcactatgttgcccaggctggtcttgaactcctgggctcaagcaattctcccagctcaggctcccaaagtgatgggattacaggcataagccaccatgctcagcctatgcatgggcttcttatctgtaaagtgggaataatctctaacagttgtttgtatgtgtgtgtgtgtgtatgtttcctcctcctcttcctcctccttctcctcctccttctctcttcctcctcctcttcctcctccttctcttccttcttcttttcttctttttaaaaacagggtctcactctgtcacctggcgtacagtggcatgatcatagctcactgcaaccttgaactcctgggctcagataatcctcctgcctttgcctcccataatgctaggattggcatgagctgccgctcccagccaactattacaatttttatcatcatcagcatcatctgtttatttaatgctcaaagtgtgaaataaatggcttcaaaaaaagtgtaagagatgggaactctcaccctattctataactaaggagaatgagcatgaagggctcaaatacttgtgtaagacacacaacaattcagtgttggagccaagagtcagacttggatgtgctggacctaaagctcagtttctttccactgtgtcacgttcatctctcttggtaccttgcgtccttgaaaatgatggatgtgggaagcagccacaggcaggtgggaagggcacaaaccgtggagttggagcacctggattccagctcctacttgctaactgcatgacctgggacacataacttctgctctctggacctcagtttttctgtgtaagatggataataatacccacatctgagggttgttgtgtcctcacaacagtaaagctatcacagagcatattctgtgtcttgtcatagacaatctattaggtggttctaaatctccttcctggctgggcacagtggttcatgcctgtaatcccagaactttgggaggctgagacagaaggatcacttgagcccaggacttcgagatcaggctgggcaacatagtgagaacccgtttttacaaaaataaaataaagaaaaattaactgggtatggtggtgcatacttgtagtcccagctactcaagaggctgaggtagaaggatcacttgggcccagtagtttgagactacagtgagctatgaccatgccactgtactccagcctgggcaacaaacaagaacttatgtcaaaaaaaaaaaaaagaaaaaaaaaaagaaaaaagaaaagaaaagaaaagaaaagaaaagaaaagaaaagaaattaggccgaacacggtggctcacacctgtaatcctagcattttgggagcccaaggcgagtggattgcctaagctcaggagtttgagaacagcctgggcaacatgatgaaaccccgtctctactaaaatacaaaaaattagccaggcatggtggtgtgcacctgtaatcccagctactcaaggggctgagacaggagaattgcttgaacccagaggtggaggttgcagtgagccgagagatcacagcattgcactccagcctgagcaacacagcaagactccgtctcaaaaaaaaaaaaaaaaaaaaaaaaatctatcaatccatcaatctccttcccactacatgtggagccctcattcctttcctctggcttcatctttacttcctgcccagggaaatcatttctacctgaatttctgaaatactattccaccctttgctcattctatgtgctcctattttctttccttgaaagtttccatccatttctatggctccagtccctgcttacagttaatgcctagatctacgtgtgtacctgggcctctaactgaagaattaaaacactgtttcattccaaggaccatcccgaagtaaaatgatggtttgagtaggcctggtcttcagtcttcagcttcttcatgttgtcccccagcctgctgcggtcttcctcctcccagcccctggcacctgagatcttggggttttctccccttctaaccaaattgatctttggacagaatttgaaattccttcccattcaggtgaaagtaacagacaaccactaatacctcccaagagtagttatcttttaatgaaggccaggaccttgagcccaagccctgaaatcacactgcagaatttcactttgttgcctctccatggggaggatgcttgtttccatgcccagggtcttccctggagaagccttgccatgcaggccactggaaccctcttctgcttcagccaggccctggtgatggatctggaatgctaccttgcttttgggggcagcattgtagtcacacttgtcatacctatgacatctcttatctttgtatctcaaagagcttcgaaaatgttaattaatttgagacactgtctaaaaaagcagacttgcagatggcaatctccaactacaactgtagtttcttttatactcacaagcctccattgagaaagaaattcaaagttgctaaagtccacgtcacctgaaatcccagcactttgggagactgaggcgggcaggtcacctgaggtcagaagttcaagaccagcctggccaacatggtgaaacttcatctccactaaaaacacaaaaattagccaggtgtggtggtgcatgcctgtaatcgcagctactcgggaggctgaggcaggagaatcgcttgaacccaggaggcggaggttgcagtgagccaagatcatgccactgcacttcagcctcagtgacagagcaagattccatctctaaattaattaattaattaattaattaaagcccatgtcagccctcattctagcaaagaggtattatgtcccggtgatttgactagttttagttatgctcccaggtgatttctaaaaaccatttcattgttattattccatttgtattaggcagctacatcagcacatgggctcaagccccagctcccaattccaactccatgactctggataggacttacaaactttctgtttcaatttccccatctataaaatgagatactactacctaactcttggaattgttgtgagccttaaatgagatattatctacaaagtacctacctctatgcctggtacttagagacattgggtaaaagttagttcccttctcttttcctcccccacattcccaccctttgctacatagcactgtagagaaataatcagaaagatacattcactgctcttcagttctgtgtgttccaaaaggagatacatttgatcattaaaaaccacaaaggcagcggccgggcgcggtggctcacgcctgtaatcccagcactttgggaggtcgaggcaggcagatcacgaggtcaggagatcaagacaatcctggccaacacggtgaaaccccatctctactaaaaatacaaaaaattagccgggcgtggtggcgggcgcctgtagtcccagctactcgggaggctgaggcaggagaatggcatgaacctgggaggaagagcttgcagtgagtggagatcgtgccactgcactccagcctgggtggcagagcgagactccatctcaaaaaaaaaaaaaacaaaaaaaaaaaacacaaacgcaaattccttctgtcttttcaagggttcaatttcacccttttctactctttactaggaaagagaagaaagcgaaaataaaagatgaactgaagagaagttgtggagagatgtgtgtgatgatcattgtattagacacattaaaaataagcagagtgctttgaacagatagtttatctacagtctacaaagtggaattattaaccaggcctaagctgcaatgtataagaaacaaccagggccaggcacagtggcttacacctgtaatcccaacaggtgatttgggaggctaaggcaggtggatcatctgagctcaggagtttgagaccagcctagacaacatggtgaaaccctgtctctacaaaaaagacaaaaactagccagccatgatggtgtgcacctgtagtcccagctacttgagaggctgaggcaggaggatcacctgagcccaggaggtcgaggctgcagtgagctgagattgcaccgctgcactccagcctgagtgacagagcgagaccctgcctcaaaaaacaaaaaaagaaccagcagagtgtccctgtttaaggagacactgtgacaactaagcatttggtatggctgacattcatctcaagatcatagtaccacagaaatctcattcagctcatcagagccttcttaaacctgctctggacaaccccattctcctagagccaggtaggtgaggcaggtcagtaactataaatcactagcagcctttcgagctcacgtcagaaccaggagagccagagcagtggttaaatccatgaacaaatgtgaagctatattcaggaggtgaagcaggatgtcaggagcccaggtcaggagacagagttgtaaatagtggatgaggcctgggatggggtgcaggctgaatggagcagtgtcagctgatccaaacatgccaggctgggccaggcatgcagaaggagccaagtgccaaccctggaaagggaggggaacagatgagagaggagcagcaaccaggaaagagccaaagctgaaaacaagcagaacaagaacaggtcaaggtcagaacctccactgtcaaatccaagcgtgaatgacagcaagaacagagtccagaagccaggctgagtgctggaacagctcctccagactggacatgctgtgagggcaggggtcccagccgccttgctaagtgccgtgtgctttgagcccagagcagtgtttggcaggagacaacaaggcctacataaatactagttgtccacgccattgtcgaaattggcagaagccagtgaatgaacaacatgagggaaacagggatagactaaattgtgtgcacaacctctgaaagtgagcccttctcagtgagtgccctgacctgtcttaaagtgctggggttgatccaaccgttttcatttcatgcacctcaaaccttccctctctccttcctgacagcctgtattagtttcctgtggttgctgtaacaaatgaccacaaacttctgttgtctctagcttaaagcaacagaaatgggctgggcgccatggctcatgcctgtaatcccagcattttgggaggccgagacggatggatcacttgaggtcaggagtttgagaccagcctggccaacatggcgaaagcccgtctgtactaaaattagctagcggttgcaggcacctgtaattccacatacttgggaggctgaggcaggagaatggcttgaacccaggaggcggaggttgcagtgagctgagatcgcgccactgcactccagcttgggtgacaaagtgagactgactcagaaaaaaaaaaaaaaaaaaaaaaaagaattctctagagacctgaagtccaaagtcagtatcatagggccaaaatcaaggtgtgggcagggccacattccctccggagggtctgtaagggataagccttccacacctcttccagcttctggtgtctccaaacgttctctggcttgtggctgcatcactcagatctctgcctccatcttcacagggctgctttccctccacgccttctcttctccatgtgtctctcttctgtgagtatctctctcacaaggatgcttgtcaaggcagttagggcccacccacatcatccaagaaaatctcatctctagattcctaactcgattgtatgtgcaggcaccctttttctaagcaaggccacattcataggttccagcatgtaggcatatctcttgggggccatcattcaacccactacacctcccctgtcaaaatgtacctgtcttaggccagacacagtggctcatgcctataatcccagcactttgggaggtggaggcagtcagatcacatgaggccaggagtgtgagacctgcctggccaacatggtgaaaccctgtctccactaaaaatacaaaaattagccaagtgtggtggtatacgccagtaatctcagctacttgggtcgctgaggcatgagaatcgcttgaacccaggaggcagaggttgcagtgagctgagatcacgccactgcacttcagcctcaggaacagatagaaacactgtgttaaaaaaaaaaaatacctgtcttgtgcttcattactttaggtcccatgagatattatattttcagcaaaaatgttaatgatgtaatgtgtttcctttctgttttatatcagataattcctagagatgtaaggccttggtcaagaaaacggctgtctaggggctaggatttcaggccccaaccgggcctctgaagaggctagcttggagaagaggctttttttctcagcatcaacccttccatcagctcacagtttgcacggggtttgcccctgtcatctggtcactggaaatcatgggagagttggaagtactgttggagcattccatctcctcctggctttctaaataacttttgcatctttctagtcctaatccttccctttaaaactagttaatagaagctctgtactgtgctaagcaatttacaagcatcttatttaatcattgtaacattctttatgaagtagttacaatcatttttgtacgtttcagagaaagaaattgaggctcagatatgaaatggcagagccaggacttgaacccaggttctctcactccaaaccccatcctttgaaccaccctactgatgtacctcctatggatcttcagatagcattttctcaaaactgggctgtcagaagcatgatgggcgtggccaagggaggattacacaagctggtgagctgcgatggagagccgctggttctgctcccagaaagtcaaggattatggagtgtgatggttgctgcctggggtggagagtgtgcatgtatattgattagtgcctaccatactaagaaattcccttctctttagaagtgaacagtctcaaattggcaaaatatagaaggacaaaggtgtaaaaggactgagcagaatccgaagttttcctgtgagcatggaggtggggcagggagaatgaagaagaaaatgcaactgagaaaataagtctagttcttggtaaggtgagatgtctttgacattcatgaaggaacttcctgttccttcctagcaggaagaacatttgcctggtgatggtctgtcagactaaactgccttacctataaagaaggcaggaaactaacatttgagcatgtagattttcagactatttcccttggattatttcacttcatcatcagaggaagatgttcctcccttcatattgcagatagggcaatggggctcagagggctggagtggtttgcccaacatcattcaactagtaatggcaaagctgagatttgagtttgtcttctaactccaatctcagggctctaatttagattgcagttgatcatttattataaaaccttggcaatgcttgattgcctgtttcagtgtgaagagtgcacttgtttcacagcaaggtgaaatcagaaaacgtgcaaggtcactagcctccccaaccctgcctgccttcttgtgtctcaactccagctttgtccacctctgcctagaaaactccttctcaaactttaaaatccacctcaagtgcctcctctctttgaaactttagatccactaccttctggctccaggtagaatagctgttcttttacatgttctttcagacccatatgcatatgtgcattactaataagtcacttttaatatgcctgtctcccccactaggatgtgaactgctcaaagacagggactgtcctattccttgtggcccagccaggcccagctcagggaggttaggcaagagctgttgggtctaaggctctcagtgcagtctactttggctctgaacttcaccagtgcaatcaggtaaaccttggtctcttccttcccctagctagatgtccaagtgactcatgccttttcctagaggccataaacatgtccctgctcagatgctagtgctgagttccactctgctatgtggctttgctggtgtccccttgcctatctccatgtggtctccatatgtcccctatatccctggtctaccctgctctgtccctaatcatacaggctagacttggcttgactttgccactgctctggtgacatctctcctctccttctcatccactcctgtccctgccacatcactccagggaaaagcaaactgaaatcctctcccaaccactggtgcattacgccctatgacaggcacgataatggcccttaaagatatcacgccctaatccctggaacctataaatgttacctaataagaaaaagaggtctttgcagacgtgattcaactaaggatactaaggtcaggtatagaggctgaggcaggtggatcacttgagctcaagagttcgagaccagcctgggcaacgtggcaaaaccctgtctctacaaaaaaagaaaaaagaaaaatacaaaaatttgccgggtgtggtggtgtacacctatagtcccagctactcaggaggttgaggtgagatggactgcttgagcttgggaagtcgaggctgcagtgagctgtgttctcgccactgcactccagcctgggcgacacagtgagaccctgtctcaaaaaattaattaatcgattaaggattctgagatggagagattatcctggattatccaggtgggtcctaaatgaaatcacaagtgtcttataagttagagaatgaggagcattacacacacacacatacacacacacacagagagagagagagagagagagagagagagagagagagagagagagagagagagagagagccatgtgaagccacaggcaaagactggatgcagccatgagccaaggaatgccagcagccaccaggaactgcaaaaggcaaggagcagtttctaccccagagcctctggggggagtgcagccctgctgccaccttgcttttgacccaatgatactgattttgaacttctggcctccagaactgtgggaaaataaatctctgtagttttaagccacccagtttgtgctaatttgttacaccagccacaggaaactaatacaggtcccaaagggattgaccttgctctcctagttttttttttttttttttaaccccgctagttttacaactggctcaactgcctcactcctctggcttcttacagcccctttctctaaggacctggactagtaaccaccatttattgagcacctactacatgccaggtactgaggcttccatgggctacatcactaatccatgcaataaccctgtgagatgggtattgaggccaaaagaagtcaggtgacttgcccatgatcacacagctgctagaaaatgccagagctgggatctaaaagcaggtctaactccaaagcctatggctgtgatcctgctgcctcactactcaagtaggggccatcactagttgactgactgccagttctcatgtgtttttctccaaaagcctattggcatctcatacaaataataagtgctattatatggcaggcattgtgctcaggactttacatacattattttatttttctcatcagtgcaactccatgaggtaagagctattatcatccctttttactgacaaggaaattactgctaagtggtagacccggcaccaggccctgggtttctggggtcctggacaagtgtcatttcctctgatctgctcagcctctcatttgcaccagtgccctgggctgtaatttgacttggacttggttcagacttctgaaaggcctctgtgttgtccaaagtttggaggacttccaccaagtttatgtgtggagcttgcttgttagtttccagagggttcaaaacacccacagtgctgcataaatattccactgcccagacattcacaaacaccctacccacatctttaaaagtctctctatctagtcctatctgtggcctcctcctctcctcattagaagccttgagatagttacattgcaaaattaacatattaaaacaaatttgcaaaatataaattattgtaatgcattataacaatgataatataaaaattgggaaagaagaaaaatgttaaggatttcatcaaaatatgtgtcctaagtaaagtcttttataaaaatgcatctcagtggaggtggatagagggaagaatgccagggaagacagaaagaatgaggcagaaagcaagattctctatatttataaaccctgaatacctaaatgggtttatttagaatcagtggtcatttgcatgccttcataggaaatgttgaaaaacttaattgaaacagcaattcatacagcacagccaacagacaacaaactgcctttggaagtgaatgaggactccctgaatttcctggatcatcttggttctttatagactttgcaaaggaacaagaacccaacaaaagggaaaaagaactctccatgattgttgacagctgtataataatgaaaagagaccaggacctggccgggtgcagtggctcacactatattcccaacgctttgggaggccaaggtgggtggatcgtttgagctcaggagttcaagacaagactgggccacatggtgaaaccctatctctaccaaaaataaaaaatagccaggatctcagctactaaagaggctgaggtaggatggtctctggagcctaagagttggaggttgcagtgagccgagattgcaccattgcactccaacctgggcgacagagtgagaccttgtctcaaaaaaagaaaagagaaaacaggaacaggaacagagaaatctggatttcagtcctacttcttcccttatatgctgtgtgatcttggacaaggcacttcccatctctgaccttcagttttttccatctgtaggtaatctctatggtaccttcaaattctaccagaatatttttaactaaaatagcatcatagctacgcttcgcatttttgcttttgcttttcttctcacagtcacataatcaaccaagagaatgaggcaaggagttgtggttgctgctgaacacacacatttatctagagggcaaatgtagactttggtttaaattcttctgatgaaactgtgtctcacacccaaatcccaagttcaacggactgctcttgagatgccagccgtggcggccttgctagggaggaggcccatgatggcctgtgtctgagtctgtttcattgcaacactcccagaaagccagccctgtcattaagctcacaaagtaaacactgtcctcagcaaaagcctgagttagcagtcacctaaaggcaactgtgctcctttaaggggagagctttcaccattcattgctccaccagtgccggccttaaaacttgaaatcaaacgcagggctcccaaggcgctggcctttcatccaaaaccaccgaaggctgtgggcaggattcagaattatgtttcaccagctggtccaggccgcagtttgtctggggagagaaacagacacagggaacaaagagatggaggtgggaaggtggtaagaaaagggcctttctgctgttattgccacagagctatgggtggtattaacgtaatcagaatattttacccagaagtccagaacgtagaagtatcaataagcatttcttgccccaaacatttattgtaggcatatcaagtttttaccatgtcattttggtcttttttttttgagacagagtcttgctctgtcacccaggctggagtgcaatggcacaatcccagctcactgcaaccttcacctcccaggttcaagagattcttctgcctcagcctcctgagtagctgagattacaggcacccaccaccacacctggctaatttttgtttttttgttgttgttttttgttttttttgttttagtagagacaggggtttcaccatgttggccagtctggtctcaaactcctgatctcagatgatccgccctcctcagcctcccaaagtgctgggattgcaggcatgagccactgcgcccagcctgttcttgttaattaatatgcttcttcctcattatgttaaagctgcatcttgtgtgcgtgtactgaacccccacctagctggcaaattcttcaaaggcaggagaagttcccattgtttagtttccaagcccaacaaggtgattggtgctgaactgagccaagacaggcagactgccttcaccagggagtcaagagcagcaccttggtgtatccccaatgcccttctccgggggtatccagtccatccccattatttttgtggcccacaaggcagtacctcctcccccaggtctgagaagactgaggagggtgttattaggttcctacatggcccagactagttgatatcccatctgggacttgctgaataatgatgataataatagctaacatttatcgagcacttactatgtgcagcctctgctaaatactttatcttgcaacacaatcctcatgccagccctctgagatagcacttttatcatccccactttacaaatgtaaaaactgagactcaaaatacacagctaggagacggtagacctgagattctggtcagggctgactgacgtggatcctgtgtttgaactcctagcatacgctgcttcccaaactagtttgtaaattcttttgagagcagagattctatctttttcttttctgtactcacagagcctagaagaatcctgagcaacagtggactcttagcatctacctgtttcttgactgactcatgagcgatccatgcccatggcagtcagagataagagtgacaagaggttagagagggatctggcaaagaaagtttggagagctgcttatagccaggtcaatttagggtgagggagtgtaggcacagaggcccctctcagcagtactcagaagcttccagagcatcctgagcaggaaggtggccttcccttctcaaggaggactctctaaggaataaggaggcatccgaacatagcaagggcagaggagtggctatggagccaaatctcattcaatgtctctgtcttggtgatcactaagaagccagtgttgctctctgcagcaagctgctcatctgttgtcctgattgacctccagtttagaaaaatgcacagtatccaactgttcctacactttgactgctctgcaggattttttccctcttcctatattgaacatgtgaaggattgcagccctttttttttctaatggcttatgttttgatgttttacctgtaaatcaattatttggaactgataacacatttcccataggaaatcatgttgcttaaagaggttaggatctcaggctatgtcctaatagtcttattttacccattgtttattcctttttttttaattttcttattttaagagacagagtctccctatgttgcctcccacctcagtctcccaaagtgctgggattacagatgtgagccactgtgcccagcctttacccattattaatagcagtgagcctgatgtacatatcacctacaaataatcatgttcataataggaaaaaatgtattaggttggtgcaaaggtaattgtggtttttgccattatgaaaccgcaattacttttgcaccaatctaatatattcctaattctaactcagcaccccaggacagggtttcccctacctggggaagtagagatttctggagatgaggttagcagcactctgctacctcataactttctaactgggtttgcagaagagatcagaacttgaggatataagatcatgccagccttatcaaagaagtcatgtctgcagaagcaacaggtttgcaacacaatcattgcagcaacgatccagatacacactgatatctgttgattcaggatgacacacatgagggtatgagtcacacacctgacctcctcaagacatcttaaaagttcaaagggaggccgaggcgggcagatcacgaggtcaggagattgagaccatgctcgctaacatggcaaaaccctgtctctactaaaaatacaaaaaattagcagggcgtggtggcgggcgcctgtaatcccagctactcaggaggctgaggcaggagaatggcgtgaacccgggaggcggagcttgcagtgagccgagatcacgccactacactccagtgtgggtgacagagcgagactctgtctcacaaaaaaataaaaaataaataaaggtcaaagggatttccaccatactcagcttgttaaatctctgaagtggaaagatcaatactcctctagcccaactccagcccaagactccttcctatgcctagtactctgtgctgagaaacagggagtcgcagaaggaactccttcaagaagcttcttattcatttttttaaaaaaatcattataatagctacttcttttttttttagtactaacttgaggccaaaggctttatatgtttcaatttgttaaattctcataaaaaccctatgtttagatttagcttcacttagaatataaggaaactgaggtttatcatgattaagtaacttgccttacctcacacagctaatacacggaaaaatcaggattcaaaacccagtctgttgggtgggcacagtggctcatgcctgtaatcccagcactttgcgggggccaaggcaggcagatcacttgagatcaggagttcaagaccagcctggccaacatggtgaaaccccgtctccactaaaatatacaaaaattaggcaggtgtggtggtgcgtgactctagtcccagctactcgggaggctgagatgggagaattgcttgaacctgggaggcagaggttgctgtgagccgagatggcgccactgcactccagcctgggcaacagagcaaaactccatctcaaaaacaaaaaacaaaaaacaaacaaacaaacaaaaacccagtctgtgacgtcacactatactccataaatatgtacaattattgtgtcaattaaaaacaaaattttaaaaataaaaaataaaaataagtaacattttaaaaaacccagtctgtttgcaactccagagtccaggctattaactgctatggtataattgtttttccagaggtatggaggaaacatcaaaagattataaaacatagtcactgttaagtatgtcaaacttatgtatttttatttaaataataatcttgaaattgatacagtatatgctggatcatcaggcagtgcaactataactaagtcctgtcacacaatataaaggctcccttttctgttgatttctagccaagaggaggccaaacaaataccatgatggctcactgaaagaatgagggttttaggctgggcacagtggctgatgcctgtaatctcagcactttgggaggccaaggcaggaggattacctgaggtcaggagttcaagaccagcctggccaacatggtgaaactccatctttactaaaaatacaaaaattagctgggcgtgttggcaagtacctgtaatcccagctactcaggagggtgaggcagaagaattgcttgaaacaactgggaggcggaggttgcagtaagccgagatcacgccattgcactccagcctgggtgacaagagcgaaactccgtctcaaaaaaaaaaaaaagaatgagggttttacagtaagttgaacagaagcaagtcatgggagcttctccatgaagtcacgtagcacacagcagtacaggcatgctgagcacagaaggaccttcccttaggtgtcatcctcacactgggagcagacatattacacagatctcattatactgtaaccagcattgcacaccatgttgactcatcattttgagaatgagctacttggctgttaaactgcctcagtctctagtgagaattgttgaaaagtaaaattttttcccaagtctccccttagctatttttctttctttctttctttctttcttttttttttttgttagtagggacagggttttgccatgttggccacactggtctcgaactcctggcctcaagcaatgcgcccgccttggcctcccaaagtgctgggactacagtgtttttctttcttgatgatgcaatatttagtcataaatatcctctgaaatcttctcattgtcctaattaaaagaagaaacttttaagaaaccagaagatagaagcctgctagaccagtcctcccatatgagtcgaacatcaaagtcgtttatgaaaaaggaagaatcacaaagtttcagtttgttacaacattagagtaagagagaaagaagcatagaaaaagcagtacaaataggaagcacaaaataaggttatagaaatgaatccaaatttcagtaatcatagtaaatgtaaatggatcaaattggcctttaaaagtacaaaaaaagttagagttttaaatattagaaatccagatatatactttttataagaggcttgctaaactgtaaggatcaagaatgacagaaagtataagtatgtaaaaaatagaggctgagcacagtggctcacatctgtaatcccagtgctttgtagtactgggagttgaagactagacctggctacatagtaagatcccatctctacaaaaaatacaaaaattagccaggcgtcgtggtatgtgcctatgctcccagctactggggaggctgagatgggagacttgcttgagcccaggagtttgaggcttcaatgaactgtgattgcaccactgcactccagcctgggtgacagagcaagaccctgtctcaaaaaagtaataataataatatatattttttaaattagctggtcacagcagcatgtacctgtagtcccagctactcgggagcctgaggcaaaaggagtgcctgagcccaaggggttcaaggctgcagtgagccaaatgccaccgcactccagcctgggtaacagagcaagactctgtctctaatagaaattaaaaataaaagtgaaaataaaatatatctggcaaatagccaccccttcaaaaaagctaatgttgttgttattaatatgagacaaatgagtttaagacaaaaagcatttttagggatgaaatgagtcactatatttgataaaaatttcactggaggccgggtgcagtgtctcacgcctgtaatcccagcactttggaaggccgaggagggcagatcacaaggtcaggagatcgagaccatcctggctaacacggtgaaaccccgtccctactaaaaatacaaaacattagcccgcgtggtggcgggcgcctgtagtcccagctactcgggaggctgaggcaggagattggcatgaacccgggagccggagcttgcagtgagctgagatagcgccactgtagtctggcctgggcaaaagatcgagactctgtctcaaaaaaaaaaatttttttttcactggagagctataacaactctaaacttatatgtccttaataacatatcttcaaagtatgtaatctaaaaattgataaaactttgtttcaaattgaaaacatacatggtgatgaggataaaaaaactgaggaaggaaggagagaataaacatatgttgagggcttactatttgccaagactgtgccaaatgctagggaaacaaggatgtggagacatagtttctccccccataaaacttccatatggaaataatgtataatgtgataaaggttataacagtgggatatacactctttttttttttttctcttgagacggcatcttgctctgtcatcaggctggagtgcagtggcacaatctcggctcactgtaacctctgcctcccaggttcaaggatccccctgcttcagcctcccaagtagctgggattacaggcacgcacccccacacccggctaattttttgtgttttttagtagagacggggtttcaccatgttggccagggtggtcttgatctcctgaccttgtgatctgcctgcctcggcctcccaaagtgctgggattacaggtgtgagccaccacacccggcccaagggatatacactcttaaaatgaatgatggaagacaggatgaagttactatctgaatcagaagaggagggggtaaaggaaaactcatatagaaatattttgaaatggtcttaaaggatgagtaagagttcaccagatagacaaggggcagaggggcgaggactagggagaagagcatgtcaaacagaggaaacaatacacaccaccagccagagaggtaagaaagcatagcatgtacagaggtctaaagcattggataagtaaattgaggaagaaaaaacatttttactggtaacgatttcacatgcatgaagccttagtttcagtgacatttacacacaccagaaagaagaactggacaaggttcctcttcagcacagaagtcactagaaaaatataactaatcacatgagggatgggaggagtttagaaagctaccagtttaatttcccttggcaaatcctgcagtgcagatttgctaagttccagtgtaatgcactctggtgatgtcattttagcctcggatgattgcacatcccaaacaaccatgtgactaataccctctggctgtcaccaaaagtctaaacaatatgagcagcagtgctcagcctcagcgtgctagcaagctgccttagttcctcactttcaaattacaatctgacttgttacatgtaataaacaggaggtgagaaaggagaaagaaaaacaagtgtggaaactattccatagtagtgctatgacctaacacatccatttgatttcagttggcaagggaagcagaagatccagtttgacacaagaaatcaagaatggttgcacaacaggctgagttgggaacatcctttatatattgtcagtctctgccatggccggtaattcactcaattgtgaacaaaatatcttacagagtagccaaaaagttttagaaaataatgtgcacttttttttttatttttttcccctttcatacctagtctggtagaataatctgcactttagaagggacggcttttctttctttcttttagacaaaactgtgccccttgattttggatcccatttatgctgatacttttaaataagcaattttctcatgtgcagtgggaattgacacctatctaaccaatttttattttgttgatgaaaactgaaagcggaagctagaagaatggggggattgtcctcttttctatatatttttttctttttgatgtcctttacttcaagttaagcctggtgtttgctttaatcacagcagaaagcattttccatttcagggaaaggagagaacaggccataaaccctgtcccctgtttgttctccaactacccatttttgtcctttgccctgccatgtcttttccccctcgtttgcttctcctttctttgttgatttctcagttcttttctggcctcactcaaaatggcagaaattacgcaacctagtacttttttacacaagctcctttagtgtcaaggattcatcaagtgcctgccatgtgccggaactgttctagatgccgagaatactaccatgaatgaaatagacagaaatcccggctgtcattgggctttgtctgagggccattggggaaggcctctcaaaggaagtgatagctgagctgggatctgagtcatgaagaggagtgagcccaggggacaacagctgcaagagtgtgccaatgggagagaccagcccagcaaaaaggagaagcataagtctggtgcattccagggacaggaaggaatggggcagggtgcctttaagagaaaagcatcagtttggatgaggagggatgtagggtcgggaatacaaaataagagtaattatggctgggcacaatagctcacacctgtaatcccaggactttgggaggccaaggtgggcggatcacttgaggtcgggagttagagaccagcctggccaacatggcgaaaccctgtctctaccaaaaatacaaaaattagctaggcctggtggtacgtgcctgtaatcccagctactcgggagactgaggcaggaggcagaggttgcagtaaaccaagatcgcgccactgcactccagcctgggcaaaagagtgaaagtgtgtctcaaaaaaaagagagagagagagagagagagaaattaacttagggtgaaaggcattttgcccacaacaaaggagggattcctctagatccaccagatggaggaaggtttgagagaacaaagatgatggttgggttccagggtctgagtagaagcaggagaaggaatcctctttttttttttttttgagacggagtctcgctctgttgcccaggctggagtgcagtgacgtgatctcggctcactgcaagctccgcctcccgggttcacgccattctcctgccccagcctccctagtagctgggactacaggcacccgccaccacgcccggctaattttttgtatttttagtagagacggggtttcaccgtgttagccaggacggtctcgatctcctgacctcatgatctgccctccttggcctcccaaagtgctaggattacaggcgtgagccaccgcgctcagctggaatcctctttctttagaggtgtgaagagtgggaactggggaccagtaactcggagaggcaaggccaggttcatggaagactggggggacaaatggactgatggcaacacacaaagacgcacacttatgcagtcacatgtgcacaaagcgacagcaggcgccttttcaaagtatgccgggttgagtgaaatgacctaaacgtatctttttatacagtaagcaggagggcagagaccctctttttatagactacattctcaacatttttaaaaacatttgctcctggcagggcgcggtagctcacgtctgtaatcccagcactttggcatgctgaggcgggagaatcacttgaggtcaggagttcaaaaccagcctggccaaaatagcgaaaccccatctctacttgaaaaataaaatacaaaaatcatctgggcatggtggcacaggcctgtagccccagctactcgagaggctaaggcaggagaattgcttgaacctggcagagggaagctgcagtgagctgagatcgcaccactgcactccagcctgggggacagagtaagactctgtctcaaagagaaaaaagaaaaaattgttccttttcagtaaacataaaaaccacatacccttgtttaaaatggtttgaaatttcaaactaaatagagtgactggaaaaaacatgcgggcaatttcagagtatgtttcttcaagttacttaagcctcctccacccagactttggtctggaaccttctgatctacccactttccaggtgaatcccagctgagctgctacagcctggtaagtgttgccagatctgcatagcagcctcaggctgggctcattaactctaaaggaaaaagaaaaaggcaacaacttagtgggctgccaaaactggttttttcgtttgtttgtttttgtttttaggcaggatctcaccatatcgtccaggctggagcgcaatggcaagatgtcactcactgcaacctccacctcccaggtttaagccattctcctgcctcagcctcctgagaagctgggattacaggcgcccaccaccacacctggctaatttttgtattttttagtagagacagagtctcgccatgttggtcatgctggtctcgaactcctgacctcaagtgatccacccaccttggccttccaaagtattgggattataggggtgagctaccgcacccagcccaaagctgtctttaaaaatatatctgtggatttagccgaatgaaggagatgaatgctgagttatgaagagagagctttgccttgcttcagagagcaaagcttggcttagtgactaaaagtttctggaaaaaagtttcagaaaaagatttcattaaaaaaaaaaaaaagtcagccgggcacagtggctcatgcctataatcccagcattttgggaggccaaagggggcagattgcctgaggtcaggagtttgagaccagcctggccaacgtggtgaaaccctgtctctactaaaaatacaaaaattagccaggcgtgaaggcacctgtcatcccagctactcgggaggctgaggcaggagaatatctagaacccaggaggcagaggttgcaatgaactgagatcatgccactccactccagcctggacaataagaacaagactccatcaaaaaataaaaataaaacccaccaaagatgagaactttctgactagtggaagtagttgacacccagcactgcaggtgagctatggtataaagcaggtacctgacctgggtctaaggtcccttctaattttacattctatgaattaatctatatctaaagaccatgagcacagtattgaatgaagatgttcacaaacatagtcattctttctctctcttcagaaatagctagataaaaagaactatcaacatcactagccatcagagtaatgcaaatcaaaaccatgatgagattaccacttcccactcaccaggatggctataataaaaaagacagataataacaagtgttggtgaggatatggagaaaccagaaccctcacacatggctggcaggaatgcaaaatggtatagccagtttgaaaaataatctagcaattcctcaaaacgttaaatgtctcctagcactttgggaggctgaggcgagcagatcacaagatcaggagttcaaaaccagcctgaccaacatgatgaaaccccgtctgtactaaaagcataaaaattagctgggcgtggtggtacacgcctgtaatcccagctactcaggaggctgaggcaggagaatcgcttgaacacgggaggtggaggttgcagtgagctgagatcgcaccatcgcactccagcctgcatgacagagacagactacgtctaaaaaaaagaaaaaaaagaaaactactctcacagaaaaatgagaggcaaaatttcagcacgacttctatttgtaatttgctaattaaagtgggcattctaccatgtaaatatctgtgcctgaattctgacacagcctttttttaaaagaatgatttatcctaaacttccagatagtagcactgtgaaatgcaaacagcagagacctctgacctgtattccacgtttaacaaacacacacaaagctgattaaaagacatggaggtggccgggcacagtggctcacgcttgtaatcccaacactttgggaggccgaggcatgtggatcacctggggtcaggagttcatgaccagcctgggcaacatggtgaaaccccgtctctactaaaaatacaaactagctgggcgtggtggcgtgtgcctgtaatcccagctactcaggaggctgagccaagagaatcacctgagcccgggaggtggaggttgcagtgagctgaaattgcaccattgcacttcagcctgggtaacaaagcaaggctctttctcaggagaaaaaaaaaaaaaaaaaaaaaaaaaaaagacataggggtgcctctggccctgggatccagcccctccatgctggtccagtgcaactcatgaccctaaacatttcttcttgagataacaccattcaggattcacagaaacacttctgtatctctcttgccctatgtcttcaaaacaaaaagctttgtgggttgtgttgctgctgacattaggggaaaaaaatggctttgcaaagatttgagtggcagaaactcttacgtaaaaaaggacaaattaattaagttgtcaaattcctcctttcagagaatatgaatgcaatagattcttgcattaccaagtatcattggctaggaatgctgaggatcccttttccagcttctctgttttccaactccgagttctggaggtacttgggaattaagtggcatttgcaacagttgcacattgtgcattgtgaccatggacattttgcaatagcaaacaattcttattacgttttttcccccaagacaaggtctggctctgttgtccaggctagagtgcagtggcacaatctcagctcactgcaacctccacctcctagtctcaaccatcctcgcacctcagcctcccaaattgctgggattacaggcgtgcaccaccacgtccggctattttttgtattttttgtagagatggggtttcaccatattgtccaggatggtggctcatgcctgtaatccagcacttgggaggcctaggtgagaggatagcttgagccaaggacttcaagatcagcctgggcaatacagtgagacctcttaaaaaaaaaaaaaagttcagctttatttaaatgatttttatttaaaatgttggtattcatatatttttattttgccttctaattttaataggcataaatattttaaaacaataattttcttgaagatatacaaagtaattatgatcttaaaatttacaatcactttaacttacattttgatgaaaatatgctcaaattttaaacacaattaccttcatttttaacttgttacattattactatcaattgaacacaaattacatgaaaatctttattgtaacaacatagtggttttcctgaaatggagaaaataaaataaatgttgtggaatacataaataaaaacataaataatgtcttttattaatcatagaaaatgtcattagctcctctaaacatgtgcaataataactaaaaattagccatctttttttgcagtctttcataatactttatcaacaccatagctttacaaatgtttttaatggaccaggcacagtggctcacacctgtaatcccagtgctttgggaggctgaggcaggaggatcatgaggtcaggagttcgagaccagcctggccaacatagtgaaaccccatgtctactaaaaatacaaaaaattagctgggcgtggtgtcaggcgcccgtaattccagtgactcaggaggctgaggcaggagaatcgcttgaactggggaggcggaggttgcagtgagctgagatcgcgccgttgcactccagcctgggcaacgagtgaaactcctgtctcaaaacaaaacaaaacaaaacaaatgtttttaatgatgttatggatttgtcaagattgaagtatagagcacattttgtttaaaatgttttggctttcggccaggtgcagtggctcacgcctgtaaatccagcactttgggaggctgaggcagccagatcacttgaggtcaggagttccagaccagcctggccaacatggtgaaaccctgttggctgggtgaggtggcgggtgcctgtaatcccagctactcaggaggctgaggcaagagaatcgcttgaacctgggaggcggaggttgcagtgagctgagatcgtgccactgcactccagcataggtgacagagcaagactctgtccccctccccccaaaaaaagaaaggccaggtgcagtggctcacgcctgtaaatccagcactttgggaggccaaggcaggcggatcacaaggtcaggagattgagaccatgctcgctaacacagcgaaaccccatctctactaaaaatacaaaaaactagccaggcatggtggcaggcgcctgtagtcccagctactcgggaggctgaggcaggagaagggcgtgaacccaggaggcggagcttgcagtgagccgagatcgtgccactgcactgcggcctgggcgagagactctgtctcggaaaaaaaaaaaaaagaaaaagaaaaagaaaactacatccccctcaggcagacataatacaaaggaggccctttcttccctgcagaatcagccctgcaccagggagccagacgcagcaagagaagccagggctggatttttatccctaatgtccctcttggttgggcacctggcacagggcacaagctgcactcccatataagtggctctggcctaggcaatggcatcacactagagtaaggaaagtgacccaacttgtaatggcaggcatattagagcagagattccaaaatttcatttcatatattcctaggtgcctctgacccccacccccaaaccacagatcaaccacaggaggtccttttcacctgctgtgtaatagagggtttttgtttatgtttttgttttagtggaagggattttacaacttttaaaatatatgtatatatgtttaacccctgatctactcccgccacacagccacatcatggaccctggaggcaatggaataggaaggacagcagtgggggctgggagggcagggggaaggagacttttcagggacatccaaagccactgacttttgtcccgtactccagtgggtgtgctcctctccttgaccccaccgggcaccatactttatagttacttagaatttttgaagaccttggctggggggtctctctgataaatccaaattactatgcttttgttaaaacttttacatgccaaagcaggcaaacaacagatattttttaacatctacatttgaaaaccattctgggtatacttcactgtaatatacagccagcaaagcaaccataacatttcctcattttcctgagtaaatttagaagcaaacattttcagaatatgaaattaaataaaaggtcataggacaatgaataatatgctgtgtgtgtggttaattatacttgttctaaaaaaaagtcatcctagcctctctataaaaattgtgtgtgtagctatttcactttgaaatgtcatagggttactctgtttcaaaaagaaaatggaaaagcataaagatatttatttaaccctgaaagaaaatatttcttaagagaatgtaatgtttaattccatattgtttccctttgtcctgtggctggtttataaatatggaaggcacaattctttgtgctattgaaattaagggttcacggtattttttgtcttttcagggaaaagaatcaaacaatttagatacagaaaagatatgattctttcaacagctactaaaatctgacaagccattttaatcataaggtagatagcattataatttaatcttttccgtgatgagataatctgtacttttaacttcaaacaagatgcttaatatttaatacttcagatttcaaaagtgaaacatgtctgaaatacttgaatgaaagtcacttgtctacctattttttatttctgctgtaattaaagcagggaacttaattgcaagtgaactcattctaatactccaataagacaaaataagcaagccatgttattaatagcgatgacagaagtgatcgctctgggcagtctggcaaatacttacctgtgactgggaggttcacctaaaaaaagccacactgaggtcacttttgctttttggggtaatttcgccctaccatgctctgagagatcagagaaggatttttcctctaaactttttctcttattgtcctaggatttacactcttgcttcttccaactggtgtattaaaaattactagacacctactaagcgccagacactttcctagctgttaggaatagaaagagaaagaatatggtctgcagtccaggagctcaggctagagcattctatgctatgtgctatgctagaggcacgcacaaggctcctggtccagcccagccctcagattctgcgtccagagcagatattcagtttcttcacctggaaaatttctctagggtcgacctaaattctaaaatgtatatgattctagttagcggctcacattatttcaaataaggtgtttaatagctaaactgtatgcagctatagttactttttttgttttgttttttgtttgtttgttttttgggacaggctctcaccctgttgcccaggctggagtgcaggggcatgatctcatctcactgcagcctccacctcccgggttcaagagattctcatacctcagcctcaggcacgcacaaccacccccagctaatttttgtatttttagtagagatgggttttcaccatgttgcccaggctggtctcaaactcctgagcccaaacgaactgcctgcctctgcctcccaaagtgcaggattacaggtgtgagccaccgcacctggccagccatagtacttctataatgttgatgccagagtctcttcttggctcctctgagtgttttatgttattaacctacttaaaatctcacatttacattttatttgttggggggaggtgttgttgcgggtagtttgagagtgtgttaccccttcaatccaccttcctttgatggagaatgattttatcttattcaagttacccatttgccacagattcatagtctaaaaaaatttacttgtctttgatccttttgaaatgaacaaaatgagtaggagacacactcctattttagaaaagagaggacttaaagtggttctatcttgcgatttattgggcgggttcttgccagtgaatgaagctgatcccggcgacagcttggtttgaatcatccaagctcatggggtttgctgatttgggaatcactctgttctctatagctcttctgctggccacttctgaataagtagaaccattctccagcttgagtgttatttttttgttttgttttgtttgaagaggtttcaagaagaccaaggcaaaatcagatgaattgtagatcagtgaatttccactgggaattaacagggataaaatctttttcaaactacacagagctccccaccccacccctgtccccatccctatccatagcagcattcaagaatcactgcaataaagagtgaaaataggccgggcgcgatggcttacgtctgtaatcctagcactttgggaggccgaggtgggcggattgcctgagctcgggtgttcgagaccagctagggcaacatggtgaaaccctgtctctactaaaataccattaaaaaaaaaaaaaattagccaggcatggcagcgtgcgcctgtactcccagctacttgggaggctgagacagaagaatggcgtgaacccgggaggcggagcttgcagtgagcagagattgtgccactctactccagcctggcgacagagcaagactccatctcaaaaaaaaaaaattagtgagtgaaaataggagtcagaacctggagcccagggttccatcgatggttctgtcaccacctctccggctgctctgtgatcctggtttacattctggtcatacatgaatctgctcatctgcatattttgagttaaagtaaataaaaattttaagtgatttaaattccaaagaataaaatatgtaatgaaaaagctgtaataggaatgatatatttagactgcctactaaacttacccaaaaaaacaaacagcaaagttggtttaattcctttctttcactaagtcttgttccccgctcaaggaaataatttatttaactatagctgggttccagaagatccagtttccagcgatccccattcattgaggtgcaatttggatatgttctccaaactcctagggcagctccctttacctggatgcatggtagagagctgatagggccccacagagccaggcgtttacaagtccacagaagggtaggtgtgtagctgagagtcccttaggaaatatctcaaagatctttgggattcctgaccaaaagcattttctccttagctttatctaggaagtcttatctttagttgagactttattcagacaatgcttgttctccaaagtgttctcaaagacagcagctcttgtccggcccctcttggggtcacatgtctccttggctagccaccccgcaccatgccagtacaaaacactctcctgtgacccacccagttttcatatttgattatctggcctcacagactggcaaagttagtggtcacacacctggagtggaataaggcaaattatgaaggtactgtttatgaataaactaattaaagtagcttgtctgtggtctccccataaatgagtcgccagctcaggactagagcaggggtcagtgaattgcatccccttgggccaaatgtggccaggagcctgtttttgtaccaggagcaaaaaatggttttcatattttcaaagggttgtataaaaaataaataatagactgggcgcagtggcttatgcctataatcccagcactttgggaggccaaggtggacagattacttgaggccaggacttccagaccagtgactaagatggcaaaaacccgtctctactaaaaatacaaaaattagccaggcgtggtggtgcatgcctgtagtcccagcttctatggaggctgaggcaggagaatcgcttaaacctgggaggcagaggttgcagtgagatgagatcatgccattgcactccagtctgggtgacagagcaagaatttgtctcaaaataataataataataataataataataataataataataataaaaaggctgggcgcagtggctcacgcctgtaatcccaacacttttggaggcagaggtgggtggataacttgaggtcaagagttacagatgagcctggccaacatggtgaagccccatctctactacaaacacaaaaaattagctgggcgtggtggcgcatgtctgtaatcccagctactcagaggccgaggcaggaggatcccttgaacctgggagatggaagttgcagtgagcagagatcgcaccactgcactccagcctgggtgacagagtgagattctgtctcgaaaaacaacaacaacaagaagaacaacaagaacaacaacaagaagaagataacaaatatgtaatagaggctgtatgtggtccacaagcctaatagatttgttttctggcccttcacagaaaaagtttgctgacccatggactagagtatccacatcttatccactggggtcttttgggttcttgaaggtgagtccagctagtatcacactcccggcctcattcaatgtcatgtgagtcatacaattggtgaacttgaaagggaactgagtttagatcagtccttagtggcagtgtcttctcagagccaacctggatttgtggtataaattctggtccactgtctgccacttagtatggacccaacacaagtcacaagtcactctgctctggaactttatctcacaggtaaactcatactaacccaagctcacagagactgctgtatagccagaattcaaattcattccattttaaccataaatgcaaccagctaacaggtgagccttcacatcagcagaccagagtctttgcttcctataatcaggcttcagcacacagggagccatgtggagcatgaaatctgagtaaggagaggtgggtagatgacttatccaaagatacatttgccacagagacctgagagctcaaatccttaggccaaggccccttctctcttgaacagtagttgggagtgtgctacccactccttgcttcttaggttgaggttttccaggctacaggctgacagctctctgcctacatcctctgttcatccagactttctccatacaacggattaaattaacaaacacattctggtgattgccttcctggattacccccaggtcactgaagttaggggtattcccaaagtcttcaggtacacactggttatctctcagtttactccctcattgggtttagcctaatctctgtgtgattctatgcatgttcacatgcgtgcacatgtgtgcatgtgtgcacgtgtgtgtgtgtgtgtgtgtgtgtgtgtgtatgactggtttaactctcagaaggcaaatttatttcctattttcaggttttttggaagatattttattattactccctttgctgccaacaaggtatttttgagctattttgaaagaaaatctgtagtgcaactgttttttattatattttgagacttagctacttgaattcaaacacataagcagtttttcctgattttctattataataacttatgagactgagctcatgatgacaaatatctagtaaagcctctcaggataactcatctgttttcataaccactgttaaatagtcttatgtaatcaactcaaaacatctttaagatctcttgtttccaaaggaggtggataaaaatattttgctgttaagcaaaataataaccagttggatgcctccaacaatcagcctcagatcagaaaaatccttcccaattgtcttcctttctttcctttcttcccaccttccttccttctttcctctctccctccctcccttccttcctccctcctccccaaacatgtatagagcatctcccctgtgttagggatagtttttggcactgtagatataataatgaaaatacagtgtaataaaagagtcctgccctatcagggcttacattctagttgacaggagatagattatttaaaaaaaataaataaataagaaaaatattagcaatgggtaaatgctatgcaaagaataaaattgaatggtgtaatacagtgattactttggatgggatcatcagtgaaggcctttcttcaggataacactttagctgagacttagggacaagaaggagccaatcatgggaatctaagggtaaagaacattacagctagagcaagaccccagacaaagacccaaaaggaacaacaggcctggggagtgctgggaatacaaagaaagctaatgcagccagagtatggctgatgggcaaggaggagagtagcagtaataataagttttccatcaagagcacagaagaaactgggcacagtggctcaaacctgtaattccagcactttgggaggctgaggtggaaggatcgctggaggccaggggtttgagaccagcctgggcaatacagggagacctcggtatctacaaaaaaaatttaaaaattagctggcacgcacctgtggtcccagctacttaggagacaagaggatcactagagcccaggcagtcgaggctgcagtgaactgtgatcatgccactgcactctaatctgggcaatggagcaagactcctatctcaaaaaaaaaaaaaaaaaaaaaaagcacaggatgtggagtgtatcagtggcaaatacctttgacaatttcctcatttacagagaccgtggaaattgtcattgctttaccctgcctcatttttttttttttttgcccttgcaaaaaaatatataatgaggaaagttaggtgtgtaatatggattggtttagtctccacagctttgtttctggcaaagttcatttgtgtgtcttttccagattttctaggttatacctcaaaccaaatcagattagtagctttttttttttttttttttttttttttttttttttcctggcagggtcttactctgtcgcccaggatggagtgtaatggtgtgatctcagctcactgcaaactctgccttctgggttcaagtgattctcctgccttagccacccaagtagcatggattgcaggcatgtgccaccacacccagctaacttttgtatttttagtagagatggggtttcgccatgttggccaggctagttttgaactcctggcctcatgttacctccctgcctcggcctcccaaagtgctgggattacaggtgtgagccactacgctcagccacaagtgtcatttgaaaagagcaaaagggcaaagatattaaaaacgaatcaccatgcccctcaatatctcagaggtcacaggtgtttgaaagtcacaggtagaggaggaggacccaggtgagtgatgttttatgaattgttattaaacttgataaacttacccttttgaaggcatggaggtgtcaggattctgggtctcaaaatgtgcctcccagcttagtgatgtgggtatactaaggaaagcataaatgaggcctcaaaatgtgtgctgggcccaaagattgcaaattcataaaactcattgttctccatttatttaaaagagagctggctctgaggaattgatttatattaatcagagttataatagactgattaataaaatacaatgccatttattcattacctgtgaatgttgtaactaccaggctgaaattcatgtctgttggtcagcacatgctcttcctggtaggaaaaatctatttaagaaaccatattaaaatcagaaggttaaatgttatatatggaagctgaacaaatcaagttggacgtttcgaaaggctattttcagccgggcgcagtggctcatgcctgtaatcccagcactttgggaggctgaggtgggtggatcatctgaggtcaggagttcgagaccagcctggtcaacatagtgaaaccccgtctctactaaaaatacaaaaaattagctgggcatggtggcgggtgcctgtaatcccagctactagggaggctgaggcaggagaatcatttgaacttgggaggcagaggttgcagtgagccgagatcacaccattgtactccagcgtgggcaacaagagtgaaactctgtctcaaaaaaaagaaaaagaaaaaaaaaagaaaggctattttcattaagcattggaagcctgatacagccttttttcactacaaggacatacagtaccagctaggccgatgacctgctatgtggctggacagggaaggccaatcaatgctggagaaacactggaaaatttcaactcccagcctctccttttcctaggtctaggccactatttcccaaagagtggtctaatggcctcctacagttgatttgccttggggatttattttaatttttgtttattgttttttcttaaagaatgggtcttatcacccagactggagtgcagtggtacaatcatagctcactgccacctcaaactcgtgggctcaagcaatcctcccacttcagcctcccaaggaactgggactacaggtacgtgccactgcatccggctaatttttaaactttttgtagacacaaggtctcaccattttgcccaggctggtctcaaattcctggcctcaagtgatcctcctacctgagcctcccaaagttctgggattataggtgtgagccaccacacctgatcccagggatttatttttattttttatttttggagacaggatctcactctgtctcccaggctggagtgcaatagcatgatcacagctcactgcagcctcagtctcccaggctcaagtgaccctcctgcctcagcctcctgagtagctgagactacaggcatgtgccaccatgctcagctaattttttaactttttgtagagacagagtttccctatgttgaccaggctgccagggatttattaaaaatgcatgcatttttctttttctttttttttttttttgagacagagtctcgctgtgtcaccaggctggagtgcagtggcacgatcttgggtcactgcaacctccaactccctggttcaagggattctcctgcctcagcctcctgagtagctgggactacaggcatgtgccaccacacccagctaatttttgtatttttgtagagatggggtttcaccgtgttggtcaggatggtctcaatctcctgacctcgtgatctgcctgctttggcctcccaaagtgctgggattacaggcgtaagccaccgtgcccagccaaaatgcacttttctagaccccatctcacacttctaatcagaaggtctggtcttgagctaagatatgaattttaactagctttctggagaagtgtaatgcacaatagtgttttgaaaaccactgctagctggtaagctgtataaccataagcaagttagcgttactgaacttctctacgtctcagtttctttgtccacaaaataaggataatagtaggttctatcttccagggttattggtgggatcagatgagtcaagacatataaagctcttagaacagtgtctagcacctagtaagccctcaatgatggctattagtattttcaccattagcatcatctttttttttttttttttatgaagtctcgttctgttgcccaagctggagtgcagtggcgccatctcagctcactgcaatctctgccttcccggttcagcgattctcctgcctcagcctcctaagtagctggaactagaggcgcatgccaccatgcctggctaatttttgtatttttagtagagacggggattcatcatgttggccaggctggtctcgaactcctggcctcaggtgattcccctgccttggcttcccaaagtgctgggattacgggcgtgagccaccatgcccggcccatcattttcattttcattattcagcccaccacatttttgtttgctcacagacttgatttttttttaatcaagcaaaacctaatgcattgattactacataaagggagactacacccttgacagagtcttagtgccatctcccagatcggtttttattgacaatatttcagggtttctccctctcaagaatggaaaagatagtatcctaagccatctccacattatgaagcaggatggatttattttagaaaggtttccagtacagacattgtgattcatacttgtaatcccagtgctttggaaggctgaggcaggaggaccacttaaggccaggggtttgagaccagcctgggcaacacagcaagacctcatctgtccaaaatatttttaaaagtcatgtgcctatagtcctaactacttgggaggctgaggtgagaggatcgcctgagcccaggaattcaagcctggagtgagctatgatcacaccactgtactccagcctgggcaacaaagcgagaccctgtctctaaagaaaaaaaaaagtttctaatggtattcatagtgtttggcttaaggcttacatttgatcagagtttggcacattttttccctatcttgaaagttgttttgcatcttagttgtgggctaaaagttctctatttgctgacaatagcaacataccaacttgtttagtgtcattcctccaaatgccacttgttataaatcacctcatatttatactttccttttaaaaatgaacaaaatggctgggcacagtggtttacgcctataatcccagtactttgggaggccaaggtgggcgaatctcctgaggtcaggagttcgagactagcctgggcaacatggcgaaaccccatctctactaaaaatacaaaaaaattagccaggcatggtggcgcatgcctgtaatcttggctactcgggaagctgaggtgggagaatcacttgaacctgggaggcagaggttgtagtaagccgagattgcactactgcactccagcgtgggccacagagcaagactccatctcaaaaaaaataaaaaataaaaaattttaaaattttaaaaaattaaagtgaataaaatgtagaaatagagtcctctaaattgtctgggtggcagtgattctaactaaatgagggaggatcttggagttgccatgccagtatatttggaagtagagtaccaaaaaacaacttcaaaatttgctttgtaacttgccagagtttgtaagtagaacttagaacaccaccatttctgtcaactgtctcttcatctgaatacttcaaagtgggttatgaacattaattaagcctctaagcatccctgtgatgtggataattatactagccatccctgccttttggatgaccacaggaaaggaggaggaggttacctgaagtgaattccccaggttaagctgatttggcagcaaaaccacccagggaactttttatggttgcaatctaaataattctgcacctgctttccccaaacataaatataacttttttttttttttttttttttacagtcttgctctgttgcccaggctggagtacagtggcaggatctatgctcactgcaacctacgcctccccggtccaacagattctcctgcctcagcctcctgagtagctggaattacaagcgtgtgccaccacagctggctaatttttgtatttttagtagagacagtgtttcgccatgttggccagggtggtcttgaactcctgacctcaaacaatccacccgtctcggcctcccaaagtgctgagattacaggcatgaaccaccgcacccagcctccccaaacataaacataacatttttacatgagttgttgaaaaaggaatccaaatttaccaaatcagtaattaaaagtctaacctggtgaagagaaaacgcaggtataccctgggattagtcagagtttagctgctcagagttcctttctgtccagtctgcttcccagtggacttttgtccttccctcttatttccatttcccaataaactgagagcccacagtgctggcctgtagtgtgggaaacagcctgagttactgatgccaggcatggcctaaacagtctcctgtgggagagctatgcctaccggatccaaagtgtctacttggctccaccccatttcactcgtgtgccagtttctgctaaacatagcccagctcccagctggcaaggctctgaactatttttagctgggtccagggctcaggccaagagatctagataggtagctgagattcagctctagtgttttaaaaataataacctttattgtttttcttctcattataatttatgtttcagtttagacttttggaaatatagccgagaaaaaggtgtgaccatttagaaaacagcaaaaagaagaaaattaaaattttctgtaatactctttatcaaagtataatatatacagcaatgtgcaccaatcttaaatatacattttggtacacttttatgtaattatattcttgtttaactgccactttgatcaatatgaagaagactccacatagtgggacaccatctctacaaaaaatttaaaaattagccgggcatggtggcacacacctatggtcccagctacttaggaggctgagatgggaagatcacttgagtccgggaggtggaggttgcactgagccatgttcacgccacttcccttcagcctgggtgacagagcaagatcatatcttaaaacaaaacaaacaaacaaaaagacaaaaagaaaaacaggacattccagcactccaaaaagttctcattcgtcccttcccagccaatatccctatgacccagagataaaccctattctgacttatatcacttttgattagttttacctattttgaatttcataaaaatgaaatcatatgtacttttttttgaaaaagggtctcactctattgtccaggctggaatgcagtggcatgatcacagctcactgcagcttcaacctccctggtttgggtagctgagaccataggtacatgccaacatgcctggctaaatttttttattttacttttggtatagatggggtctcacaatgttgtccaggctggtcttgaactcctgggcttaagcaaacctcccaccttggcctcccaaagtacaggattacagatgcaagccaccgttcccagcccatatatactttttaagtctgtctttgttcactcataatgtctgtggggtttatccatgttgttacatgtagtagtagatggtttttttgtctgtttttactgtgtaaaattctaccacatgaatacactataatttattagttccccactgagacttatttggcttatttccaaagtttggttattaaaaataaaactgtcatgaacattttgtccacatattttaatggtcatatgcattcatttttgggggtatatacctaggagtggaagtgctaaaccacagagaaagcttcgatctagctttcatagatgtgccagttttccaaagtggttgcaccattttacagtcccaccagcaatgtgtagaagttctaattgctctatatcctcatcaacacttgatatcatcagtctttttaattttagccattgtggagagtgtgggttggtatctcattgtgatttgcatttgcatttgcctggtgactaatgatgtcttaagtacctttttcacatacttactagatatttggacatcctcttctgtgaaatgcttgttcaagtgttttgcccattttataattgggttgtctgtcttttccttattggtttatagaatttaaattcttcattggagagagaaagagagaggtggattgcaaatactttctctcagtctgtgacttgccctttcgaaaaagttcttatttttaatgaatccaattatcaatctttccttttatggttagtttttttgtttgtttgtttttggtttttgtaccttgtttaagaaatctggctgggtgtcatggctcacgcctgtaatcctagcactttgggaggccgaggcaggcagatcatttgaggtcaggagttcaaaaccagcctggccaacatggtgaaaccccgtctctactaaaaatacaaaaattagctgggtgtggtggcaggcacctgtaatcccaactgcccaggaggctgaggcaggagaatcgcttgaacctgggaggcggaggttgcagtgagccgagatcacactactgcactccatcctgggcaatagagactccatctcaaaaaaaaaaaagaaaaaagaaatctttgactgccataaagtcatgaagatattcttccatgtattcttcagaagctttattgttttgccatttaggtctatgatccatctcaagttaatttttcacatatggtatgaaaaaaggccaaagctcattatttttttataagactatccaattactccagaatcatttattgaaaagaccatcttttccccactatatatatgtgagtctatttctgaactctatactctcttctattgatttgtctgttctcgtactaatatcacactgtcttaattactgtaatttcatattaaattttaaaatctgatagtataatccaccaactttgttctttctcttcaagatggtcttgtctattttagatcttttgcggttctatatacatttaagagtcaacttgtcaatttgggggttttgggggggttgttttgtttttgttctttgttgtttttttttttttttgagatggagtctcactctgctgcccaggctggagtgcagtggcgtgactttggctcactgtaacctccaccttctagattcaaacgattctcctgcctcagcctccccagtagctgggattataggtgcctgccaccatgcccagctaatttttgtatttttagtagagatgaggtttcaccatgttggcccagctggtctcgaactcctgacctcaggtgatctacccacctcagcctcccgaagtgctgggattacaggcatgagccgccacgcctggtctggagccttctccattttagcgggaaagaatagaccatattcatttattccatgaagtttggattgtgaaaattgaaggagaatctcaaacttgaaaaactaacaaggaaagatatcttggaatcatcttggactcatcattctcctttgtccccctgtgaatcctgggccaccaacttctggcaatcccagctcaaaggcaactctagatgcttcctcttcttcattcccatcactgtggagtagcctgggtcagcccattcctgccaaacctggtctgataccaggcgaagaatatactgttcttcgctcattctgctgtttctctgatgaaacattttgagaagggattctttaggattttctaaggcaatggcttcctaagcagtcgtgctgcttccactcatttccatcaccttctgctgtcaaccttcttgtggctcccaacacactccaaatgtaatccagtgtccttgacacagctcgctccatctggcccttctctacttctgacctcttcttctattcctccaacctttctacctaattgctgttcttcatctatgccaagcatgtttccagctggggacctttacaaggtggttatttttcctggaaataatcaccccttcctgaacccactctcggatatttacatggcccacattctcatttttttgcagattgctgcttatttatttacttatttatttattttcagatggagtcttgctctgttgcccaggctggagtgccatggcttgatctggctcactgcaacctccacttcccaggttccagcgattctcctgcctccgcctaccgagtagctgggactaaaggtgcccaccaccttaccccaccaatttttgtatttttagtagagacagggtttcaccatgttggccaggctggtcttgaactcctgacctcaagtgatccacctgccttgcctcccaaagtgctgggattacaggtgtgagccactgtgcccagccagattgctgctcatgtgtcacttcctcagagagatcttccatgacaaccctgtttaaagcagcattcttctccatcccaacctcttaccctgcttcatttttcttcctagccttcagcactacacacacacacacacacacacacacacacacacacacacacacactctctcctagagactctcctagagaaccaatgattctggtttacccagggggttcctgggcagaatttgagtgctaaaagcaggaatgtcccaggcaaactggaatggattggtcacttctcccctcctatcagaatataagttttatgagggaaagagctttatttcattctccactttctccccagcacatgacacagtgcctggcacagagtaggtgctcataaatatttattgaacaaatgaatgcatgaataatttcttatttcaaacaacatctggattaaactctctgacctagcattccaatttcttcttgacttccccatcttaataccccaccctatttcctaccacttcctctgatgcaccctctgctccagggaccccagtctcctctctttcacaatcccttcacatgaagagccctcccctatctcttctagctgaatcagtctctttcacatcttttattttttgaaatctttatcagtgaaaaggcctaagggatgaatgggtccctatcagaattcccttgaatattgttacaaaatatatcctcctccactcccaatgctgagaaatagttatgatgttcttggggaaggaggagaaattaaacactgatattttgaaaaagttccctaggtgattctgacaacaaacatgcagctacttcaatcaaaaatcacttatctagtccatcaatggatgaatggaaaaagaaaatgtggtatatattctgcaaaggaatactattcagccataaaaaagaatgaaatatggtcatttgcagaaacatggatgaaactataggtcattatgttaagtgaactaagtcagaagacagaaaagacaaatattgaatgttctcactcatacgtgggagctaaaaaagttgatctcagggaggcagagagtagaattatggtagctagaggctagaaagggttggggggatggtgttgaagagaagttggttaatgggtacaaatgcacagttagaaggaataaattgtagtgttcaatagcatagtaaatgactatagttaacaacaatatactatacacttcaaaatagctagaggagaagatttgaaatgttcccaacacaaagaaatgaaaggtttcaggtgatatatattctaaacaccctggctcgatcatcacacattgtattcacgcatcaaaatatcacacataccccataaatatacaagtgttatgtatcaagaaagccaccaatccaaatcccataatatttcacaacccagttcaaatcctttagtggcatcactgctattaagactttgcctgacctcattgcctccccctctttgggattctaaaaagcttaggatctgaaccacacctcttagcactggtcatacaggtctggcatagaaatgtggacaaaatttctccagctttgttttttgcttaggattgctttagctattctttataggttccatataaattttaaaataattttttctagtcctgtgaagaatattgttggtagtttgatagaaatagcattgaatctgtacattgctttgggcagtatagccatttcaatgatattggttcttcctatccatgagcatgggatgtttttccacttgtttgtgtcttctctgatttctttgagcagtgttttgtaattctcattgtagagatctttcacctccctggttagctgcattcttaggtattttattttttgtgtggcaattgtgaacgggattacctttctgatttggctttcagtttgattgccgttggtgtataggaatgctagtaatttttgtacgttgattttgtatcctgcaactttgctgaagttgtttatcagctgaaggagcttttgggctgagactatggggctttgtagatatagaatcatgttgtgttcagagatagtttgacttcctctcttcctatttggataccctttatttctttctctcgcctgattgctctggctaggacttccaatactatgttgaatagaagtggtgagagaggccatctttgtcttgtgccggctttcagggggaatgcttccagcttttgtctattcagtataatgttggctgtgggtttgtcatagatggctcttattattttgaggtatgatgttccttcaatacctagtttatcaagagtttttaacatgaactgaggttaaattttatcaaaagccttttctacatctattgaaagaatcatgtggttttgtctttagttttgtttatgtgatgaatcacatttattgatttttatatgttgaaccaaacttgtttcctggagatgaagcctacttgatcatggtggattagctttttgatgtgctgctggatttggtttcaaactatactacaaggctacagtgaccaaaagagcatggtactggtacaaaaacaggcacatagaccaatggaacagaatagaggccaggtgcagtggctcatgcctgtaatccagtgctttgggaggccaaggcggatggatcatgaggtcaggagtttgagactgagtttcgagtttcagcctgaccaacatggtgaaaccccatctctactaaaaatacaaagaaacattagcctggcgtggtggcacgtgcctgtaatctcagctactcaggaggctgaggcaggagaatcgcttgaacccaggaggcggaggttgcagtgagcagagatcgcaccactgcactccggcctgggtgacagagggagactctgtctcaaaaaaataaaaataaataaaaataaataaataaataaataaaataatagagagcccagaaataaggccacgcatctacaaccatctgatctttgacaaagctgacaaaaaaacaagcaatggggaaaagacctcctactcaataaatggtgctgggataactggctagccatatgcagaagactgaagctggacctcttccttacatcatatgcaaaaatcaactcaagatagattcaagacttatatgcaaaaccccaaactataaaaaccctggaagagaatctaggcaatattatcctggacataggaatgggcgaatatttcatgacaaagacaccaaaagcaatcgcgacaaaagcaaaagtcgacaaatgagagctaattaaacttaagagcttctgcacagcaaaagaaactatcaacagagtaaacagacaacctgcagaatgggagaaaatatttgcaaactatgcatctgataaaggtctaatatccagcatctataaggatcttaaatttataagagaaaaacaaccccattaaaaagtgtgcaaaggacatgaacatctagacacttctcaaaagaagacatacatgtggccaagaagcataagagaaaaagctcaatatcactgatcattggggaaatgcaaatcaaaaccacaatgagataccacctcatacccgtcagaacggctattaccaaaaagtcaaaaaataacagatgctggtacggttgcgcagaaaagggaacccttacacactgttggtgggagtgtaaatttattcaaccattgtggaaagcagtatggtgattcctcaaagagttaaaagcagactccagcaatcccattactgagtgtatacccagaggaatataaagcattctaccataaagacacttgcatgtgaatgtttattgcagcactgttcacaatagcaaagacatggaatcaacctaaatgcccatcaatgacagactggataaagaaaatgtggtacatataccccatggaatattatgcagccataaaagaagaagatcaagccaggtgtggtggttcacgcctgtaatcccaacactttgggaggccaaggcaagtggatcatcttaaatcaggagttcgagaccagcctggccaacatggcaaaaccttgtctctactaaaaacacaaaaattagccgggcgtggtggcggatgcctgtaatcccagctactcaggaggctgaggcaggagaatcacttgaacccaggaggtggggatcgcagcgggccgagatcatggcactacactccagcctaagcaacagaaggagactctgtctcaaaaacaaactaacaactacaacaaaaaaaacaagatcatgtcttttgagggaacatggatgcatggatggagctggaggctaccatccttagcaaactaattcagaaacagaaaaccaaatatcacatgttcttacttataagtgggagctaaatgataagaacttacgaatacaaaaaagaaaacaagcactaaggtctacttgaggcgggagggtgggaggagggagagaagcagaaaagagaattagtgggtactgaacttaatacctgggtgatgtaatatatgtacaacaaaccctgatgacatgtgtttatctatgtaacaaaccctcacatgtaccaccaaaccgaaaataaaaatttttaaaaaaggaatgtggacaaaagagagttgcttattgtgaatgtctgtctggccaagaagcccctcagatgtgcagggaaggcattccctacctttctcctggaggtagctggggatgacctctccttctcattcctgaagactgtctcgctgccagaaccacccatattctgctcctcctcacccaaaattttcctgctgtaagttgacaatccttgccatcaagttacatccgctgccccaccccatcgccactcactttttctcacaacagagtcccagagctagtccacctaactagcccagcatctctaaatcacactgcctgggtattccagccagggctttagaattggactgacctggtgcctaaagacaagtcaaagcctctgagtcttgattcattcccacatctataaaagggaaactacttacttcacaggattttctgagggattaattgtgatcatgtcagtaaaaattcccagcacatggtacacttatgaacctccagccaggaacctttctgacaaaggagcaatgcctgtcacctgggcatggggacattggatctcccagccaagctgggctctgtcttaataggaatgtcactactagaagtacctaaatgttcttagagcttgggatcactcaatcacattctctgggtggtttgttaaaacctggactggactatgaggagcgagagcaacctttttttagcaacaataaagtcattctttgaggtgactgcaccgttaaaacacacaggggcaaaacagaaaaatgctgtgctcattgctgagcaggttgccctgaaaagtagagaatgaaaaataggaataacggtgggcatggggaccctgggttctagggtgctcttgtgcaggaaggagaggggacaaaaagagtaggctcttgcacagtatgaaggctttcgagtaaaaatctgaaggagatggagagattgagattcaagtcctcgttttgctagtaaatcaatgcaatttaactttgtttttgttttctagagacaggtattgctctgtcacccaggctggagtacagtggcatgatcatagctcaacacatcctcaacctcctatgctcaagggatcctcctgcctcagtctccagagtagctaggactacaggtgcataccacagggactggccaagtttgaatttttttagtagagatgaagccttgctatgttgcccagactggtcttgaactcctgggatcacgcaagccttctgcctcggcttcccaaagtgctgggattacacgcatgagtcaccaagcccagccataatttaacctttctagatcacaacttcctcaatcgcaaagtgagattaaaagtaattgtatcttttttaaaaaaagttcccagcacaatatatttactccctttcttccttctgccttcacattccctatcctttggtttgggagccagctccttcctggcaaccaaaccccaagatgtcatgaactgtgctcagcccaccatgccctgcccccactcccccccgccccccaaggattcaaaggtatcagagcatcccttgccctctatgctgccagcccagcctttgtctcccatatagggtccaggtctgtctgtaaattggaactagacttgtcttcacgtctattgctcagggtagtagaaaacactgagagatgttttctgccatgccaaataggaatcctcaataaatattccccataaactctgttataattggtggctagagtctatattgccatggacactcttctatagttacattaaggactaaattgattttgcagactgatctgagagtttaaccaccatttgtaccacagtctctgtgggaaaatatattccatgttccgaacaattgaccctttggagttggtccagttcctgagctggggacggcatgtacaatattatgttacattttgggttttatttgtatgtcttagaatcagagacttgtttgagctagaagaagctttggaaatcatttattaatgggcacattttgtaggtaatgaatccaaggttcagaaagattgaattgtctaaggttattcagctgctttgttctcccacctccaagccaatgcttttcccactatccaagtcattttgtggtcattttcccacatagtcattaaacaacttgaaagttgggaagtcatgccttcttcaacacagactcaaactcactaagtgtttcataaatacttaattggttcattattctttttgcttcagaggtctattcactgtaaggttttcttaaataacaagtaccatagagcatttcaattaagaacttattatgatagactggatttggtttaaatcaagatttaaataataattaataaatattctatttaaccagtgtttcctatataaaagacctattggtgttggatgtaactctgatgaatatatttcacagctcacaaatagtttggctttagttttaacagacatatgctattaattttaatgtggtcttatatattatgagaagctactcattttataactacataaaaaaagtaatgctttccttgtcttatctaccaaaacccaattgaaacagagacataaaaaccagttagggccaggtgcggtggctcatgcctgtaatcccagcactttgggaggccgaggtgggaggattgcttgagcccaggagttcgagaccagcctgacacagcgagaccctgtctctactaaaaataaaaaaaaatagccgggcatggtggcacatgcctatggtctcagctactacggaggctgaggcagaaggattgcttgagcctgagatgtcaaagctgcagttagctgtgaatgagccactgtattccagcctgagtgaggctctgtctcaaaaaaagaaaaaaaattaagccatttagcggtaaacctccaactgaaaaggtgaattatatgtgatttggatatactacaggagaaacagagcaacaagaaacaaaacatttacagtacactgtttcatttgaaacaaatattcacatattgtatactttccctcatcaaacagttatttcctggtatccatttcagtgagcaggatggggggaggggggagcaataaaagagaaacattcttacctgtgtagatgacttgcttttattgtaacaaaggcaactggccctgtaatctaattacaagaaaaaaaggccacagataaactcttcaacaattaaatagtcattacttgtggtagctgttcacctagctttaattgccttatagttaacagttctaaatagccagttaactccttcaattactagacatttatttttcaatcactttatcttgaaagatacggatgtactatggagttagcttaagacaaactgagagagagagaagagagagttggttggggccaccggggaggttactgaccaagggcagggaaggaggcatttatttatatttgccttataattctgggggactaaactggctgaggacatgccttatggcttagctataattttggctattctcatatgtataatgaaatgaaaccaaaactaaatcttaagaacaaatcttggccctgcctggctgtaccacctaggcctggctctgtattgagagaggtggcctcctaatgatgcatatatgtccttgtctggttttccaattttcttgaattgagctgactataaaagcttaatgcatgcgatataaagaatggctgacctccagatacaactagtaaaatttcaacttaccactacttaagacttattaaacacttgattgagaagaatcatatttatggaaggacagcccaatgaatgttgattcattcatttaaaagtcatcttggattaagccagagcagcaaaaaactatatatcaccccctccacattttgctacctaaacttactcactttcacaccagattggctactggctaatactgacaggcatataagaaaaacatccctatgaaagtctttgctgcgtttactaaccggagtcaccaggctgctgtttactgtgttccgaaatgccttctctaaggactatccatagagacagctctctggtctcaattcagagatggttgggttcctctgagcactggtttgcctttatctgataggcacagacattatctattagtaaaaataaaataataattttattaagacccctaaatcatgatgcccaaaccccttgcaatcaggaagtctagataaataacaggagtttcccttcatagagatttctggaattacccaaggatattaacatgcatgacccagatgcctccctaagccttatggtgtgctggcaaatgtttaacaaccattattcagaaataagacaggaaaactgccatctatgactggtaagattataggtgatttttgtattttttttcttcattttcccaacttccttcaggaaacacattttactctgaagggggtgagggtggtggctaatacttgggattatggtgagctgccctagaaactatcgggttattaagtaacacttaatatatgtaccagtttcacttcaaaatctgaagcattctgaactcttaattattttggagggatatcccacagaaaagttggctgaggccctagtgataaagctctttcttacagtggcccattcctgcccaagactccaggcactggaaaacctggtgggggtggagaaggtaacatcagcaggcaagtactcggaaccactctcctatctcctacctcttcttctcacgacctccaaaactctgctgagaccggcctccctctgcctcacttgtggtgattttctctcggatgctcactttctctctgtgcaatctttcctttgggtgtcccttgtctttaaacatgtctgcgtatacctgaactctaattgtggacagggttcaaagttctttttcatgggattcatgggccccatgaaaattagaggctaagtaggcatctaagtaggagcatttacgtgctcccaggcattctgttacacttaaagaggctcatggaagagatttgggcaagtggtataactctacaagctgctatattcaagtcctagttccagcttagccaaaacacctactccgattgcaactgatctttttcttggttgctagaaaactgagagtcatatgtgtggcctacctccagcaaaccaataggaccttacaccatgcattttgcatacaaaactgctggcttaatcttatctttcacactcacggttttcttttgtcctatttttctctgtacttatttttaatttaccctgatgtacacatttatgtaaactacgttaaatcctttcctctggaataaagtagggtgtaaataaatttaacaaaacaacaaagagtgatgatgagccaggtcttcactcctgaaggcctcaaaacgaactggcagtgatctgtgaaaactacagagaactgcccgttcatctccacagattactgaagtctgtgaaaactactccagccaggaccaccattatagcctgctgcctgttgtgttcacaatcgatgcacaaactcaaccctgaaatggagagaaaaataggggaaaaaagacattaggaaatcctagctctatgtcatctggacattagaaagcacttggttggacaaagctttttctcccccacagcacatgcctgtttcagcatctcagcccacattcacggagagggagaatatagcaattgttaagaatgcagactctagcactgcatgctctgctgtttatttgtgttatttgggctaggttttttaaccgtctgtgcctcggtgaatcccatctacaaagtagagataataatagtacctacctcacagggcagttgtaaggattaaatgaggtaacccgggtgtaacatttaaaacagtggcagagtacatacagggatctgaacaaatgttagctactattagtgatatgtgagtgggggaagcacactgccttggacttgaggcaatatcaagtctgagtttctggaaaaacacttgtggaataagtaagggctggccacctcctaaaaccggacaaaagatctggcttgcctagatccttagcgtgactgcttctcctcctgcctttctagaggcagtattacgtgatggaaatacttggtgggtgctgtgggcacaaagataagttaatgtgtttttattccctaggagctgagtcgagagtaggagaaaaatgcataaataattaccaggtaggatgattaagcaatatactggaggcagcaacagaaacacaccgtggaaaaaaaatacccacggcgtggatgaagatatgagatgtgtgaaagcgctagacacaggcagccacctgcacccatgtaaaattggattattgctgactcctacaaggcccactttaacgcttctttcaaccagaatccctgcagaactaattttgtagaaccgccggggataaagacctttatttgcaatgtcgaactccagcagagtaaccccttttgctttccacacgcgcaaacccgggtcccaaacgctgcagttcgcgtttcccggctaacggaagaaacacgaggaactgtttgcagatctaggggatgaagccaaaaaacggaaagcgaggccgaaagggcgcaaccaccacgtctggaggaggccagtgaagtagagaaaggggaaggtcagccctgccccagcgcgctctgcgtaaccgggacttcctccgcgcggcaaagccggggaacctccctggcgcctgcgccaccgtggcgagactcggcgccgtggacgtggagagagggcgacgcacctgcgcgaagacggcagcgggagaagccgctccagtgcggttgcgcggcggcccaggcgtcgaggggagcctcggcggggagcgcaccgcgcgcctgcgcggagagctgcgtgacgcggcggcgcgcaagggacgtgcggagtgagtggcgctgcgggtggggccgtcggcggcgctggtgagctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggagggtgagtgcgcgcctggccgcgggacagagggaggtcgggcaccgccgccgacccctgcgtccccgtctgccgccggaacgcgaggggacccctttcccgccccgagacgagtctctgggagcgcggcgcggcggacgaaccgaggagggggcgaggaggctctgggcgcgggggagcggcctctgggagcgcggtcaggggagatcgggggagagggggccgttcccgcggaccctcgggggccaggcccgccggccgaaggctgtgcggagcgggtctgcgggagacagcctttcggaaaggccgccgggctccgcgcgccgtggtgctcgcctccggtgacccgaggatggggagaggatgcctgccactgggctttgtgcgtccgtggaatcactgttcttctctgttctctttgtgcattgcccttggctgcctccgattgtcgttccgggagtgaattttacgtatatatatataaacctgtccttaacaggactgcttcgtctgctctgcatttttacacaatgctatatagaatggattcttcttaaagagaggataaaattagcgggaattaatctaccgtttgttacttggcctaaaaaaattgtaagacaagatatttgatcaggttgaagatgcacctaagaaatgtgatgtatgtagatgggtttgctgaagggattggcttttgcatttgatttgagcagagcttaatttctgcacaaacttagtgaaaatctatttttaaagcctgtcttgtattcgaaaggtatttgtaggtctacgcagcatttgaactttccgggctcaagtgttcttattgaatagttttatgttggtgggaaggcaaggggggaaaacgaagaggtggactagccgggagttaaatgtattgattcattgcaggatattattcaaagttaaatgcagtcttctgccaaacagtccctctaccctaaagttttcgtcatcaataattgttttgtgagtgtgtagaaaagcctttaatcctttttaaacaatttagaggcctctttgttagccgccgtccagcgattgcatatgtactgtttgctttcaaattaccttaagataattgctagagtgaagcagtatgtacttatatttggaaaatcatcaaagaatattgtaatgggggaggggtaattcctttttctcaaagtatgtgtcggtatctcaaacccaagttctgtgagtacctgttctgtaactaaatactgtgtatttgctccagatgtgaaagccatccagcagtcttaagactgaataggaagcaaaagttttaccaggaactcttatttaccttttcctttactatcaagttattcctgggaggccccctggtgcctgcagtcagtgttcactacctaagactttgtttcagatgtgaacatcttgctgggtctttgagaaatttgctttgaaaataattgtattttgtaactgttttatgagggaaatacagttaatttaaaaatgtgtatgtcttgtttacatttgggaagtagaggcctactcctttttattttttttttatttttattttttgagacggagtctcactctgtcgcccaggctggagtgcaatggcacggtctcagctcactgcaacctccgcctcccgggttcgagcgattcttccgcctcagcctcctgagtagctgggattacaggcaccccgccatcatgcccggctaattttttttgtatttttgtagagacggaggtttcaccatcttggcctggctggtcttgaactcctgacctcgtgatccacccgcttcagcctcccaaagggctgggattacaggcgtgagccatcgcgcccggcatatttttatatattttaaactttgcttgtaaatttaaatattttaaaaatatgtttgtatctcaatttatttatattttatttcattttccatatattttgtaggcataaaacagatttatgttttaaaatgtttgtatccttttaaattagacgcacctttatatgattacaggtacttaaacttcacgagtgggttgtgcaaggttactagaaaagacactgggggaaaaataagtgattccatttgtttttgtgaattcaaattaaatatttggtttgtacaatctgttttccttttttgggggggcggggggggggcgggtaagaattgtagtccagatacgtttctctcttaatttagcaagcgttaacaagttgacctcctccttgccaggcaccagcaatcctaagataagacacagtctcttcactcaaggagctcccagtctaaacaagtgtctttcaggctttttcagcctcctctctgtcctatgttcagcacacattctatcagtacttcttcatcctacagaagcatatttagtttgacagtgcccccaagggattcttaaatattctaggtttttcagctccttcccagatccagacctgttgaaagacttgtccagagcagacttgaattttctagtaaataattatttttaatcttcaaagaaaattttgtccacctggattttcagtgatattagatgctagttagtgatattttgtaaagctgcctagcaagaataactatggttagtgtttttagtgtcaaatgaacgtgtaagtaaaaatttggcaagaatttctctgcattaggggaaaacattcagcaggacctgatctcattttaaaatgctgattgtagccccacaacatattcctgattgttttttcttttttactgtattaaatcgcagatcagctatacacacttctggtgactacattttatgagttgctttttgtttttcttttttaggtgggcgtattattgataagttttttttgttttttgtttttttgagacggagttttgcgcttgtcacccaggctggagtgcggtggggtgatgttggctcactgcaacctctgcccctgcaggtccaagcgattattctgcctcagcttcccaagtagctgggactacagcatgccaccacgccccggctaattttgtatttttagtagtttcaccatgttggcctggctggtctcgaactttccatcctcaagtgatccacccgcctcggcctcccaaagtgctgggattacaggcatgtgccaccgcgcctgaccttgatatgatattttcaaagagtcctttaggtcattttaatacaaacatgccatttaatgtaaaacagaaatattgattttattatttggacggtgcatattctttcggtatgttttcttggattaacttttgcttagaactaaaaaccaaagacttctactttatcccctgtagtgaccctgttggccacattcttgtggcttaccatagtgttttgatcatttaaattgaagctagtttgtatgagtattctggaaaatccggtaaaagcttcttacttagatgagtggttctcaaagaggggtgggaaatgggagtatagcagaatcatctggggaacttcattcaaactataagtgctaagtttattttggaggaagtgaagtggaatgagtagaatctaatgcatttgggaggaggttagtatggaaaactgctgctgggtgaataagagtgccagctctgttcccaaccacagtcttgatccaggtatttaaaaactgggatgtgccagttgatatagtatgtctattatgtgtcatatatgtgataatatgaaactgtttagaatttgctttttcctgattatgaaagggcagcattctttcaagaagtcccctgtaattccacaatccagagataaccgttgttgaaattttgatatatttttgtttaaagatacttaacatactttgtaaaattcacatgctttacatcattagaatattctttacatagctttatgagttaatttttcatgtagtattacatcatgaacattttcccttgtcattgaaatgtcttcaaaaataccgaaaagcgatttgctgtgtgatagaaaagtttttcttaaagtattttttaacatattaccacgaagctgaacttgactattacaatatgagttgtagaatattagcactgtgtaaagttccatagcaaaatgtgattgtgttacatttttggcccacttacagttttatgaaaatcgtgggatgtgtttgtacctgttttgttttttaaattcatttttcatttaactttgacctgtcagatgtctgaatttgtgacactgcttgtgatctcttagtgcgtatctcccttttctttcttgtgaaacaggtatagtactcttaagatttagttaggctgacagactacacttttaacttttcctattcaagacaggctggaatgcagtggcttgatcatggctcactgcagcctcgacttcctggtctcaatcgatccttctgcctcaacctccctagtggatgggaccacaggcacatgacaccttggctggctaattttttttattttggtagagacggggtctccctatgttggttgcccagtctggtcttgaacccttgtgctcaagcaatcctccagccttggcttcccaaagtgttgggattacaggtgcgaggtgctgcgcccagcctgtagtgtccttttgaaggttaaaaaaaatgaatggatttgaaaaatgaaatcgattaatgaaagcatattaaagccctccattttaaaatgacagctttatccagatataattcacataccatacagtttgcctatttagaggatatgatttttagtatactatagagttgtgcagccatcaccacagtgaactgtataatattttcaaacacatataccccccaaaaaaccctgttcccggtagcagacaccccatttctctccattccctcccggcccccactaatctacttttttttgtctcttagatttgcctattctggacgtttcatgcaagtgaaatcatacaatatgttgtcttttgtgactggtttcttttaatgtttttaacattcatctttgttgtagtatgtatcagtactttattccttttatggctgaataatattccattgtatgtatacaccacatttttaattcattcatcagttgatggacattttgttttctttcggctattgtgaatacttgtagtgctgctatcaacatttgtgtagaagtttttttttgtgggcatatactttcaattccgttgggtatatagctgggagtgagatttctaggtcatatggtagccctatgtttaactttttgatgagctgccaggttgtttaaggcctctttactgattaaattgtttaattctgacccagcaacctaaaggttaggtggttggaaagaagtgtcagttgttgccgacaacctccacttctgtagggaaggtgttttgtgtggatgtgcagctagacttgttagaaaaaagagcatgttggggagtgggggagatcacccgaggaatattttatctccttgattcttctggatgagatactagaggagacataaggtcgtggcatattttttaactgattcagagattaggtgtttgttttctctgaattaagttcagcaagtaagggaaactgacagtttgaagaagtagcccagaggtgtttttattttgctatctgaatgcagacctggagcttttctggtaaatatctaaatccaagatgaagattcgttgggatttaatacattatttaaattgagtctagagacaaagccacattaagagtcaggattagtggggaagatagttgcatctagtaggtctttttcttccttattctccacgtttattacttttaaaagagtatacattccaatgccatgcatttttaattttttttaattaattttttttttttttggaggcagggtctggctctgtcacccggttggagtgcagtggcatgaacatggctcacctgcagcctcaaccttctgggctcaagtgatccttctacctcagcctcacaagtagctgggaccacaggcatgcaccactaattaaaaaaaattggtagacacagaatcttactttgttgcccaggccagtctcagagttctgggattacaggcacccagccccattttcaaacatttctaacaggtaaagtaatacaggtatgaaggaatgttaagattcttagaaatactgacttaaattctgttatgtatttctgaaaggttattctcgaatgttggtggcatatagggaggcaaggggaagaaatagtttgtaaatgtcagtaggtttagcagtggtgtggtagatggggattcccagtggagtcttctaggatttgtgattggatacagattgatacccttaggcagcagccactgcttctagcagctttaaatagccatttcaaggcttattcaagtataaataaccagtagccagttttttcctgatttgatagaggaagtcagtccttggtctagatgggtacttgtcatacagtaggaaaaagggcgggggcagttgtcctttattctgcctctgcactattcacatgtggagcacagtgatttgtgagagtatgtataaccttcgtgaacatcactggcctcagaaccctcccttgccaaatttacctgcatctgtgcaaagacaagtggagatattgatgatatgtgcatatcccagagggaatagcgtttgctttttgatgcatgcccacccttgcataattgggaggttttaacatagcatatttcaccataaaggaattttattctaagaatgttaatcagaatatccctaagtaacagaagttcccatctggtcagttgcaaggtgaccaaaacactttcttggtttgagtatagtcatatgttctgtcaaatgatgttttggtcaacagtggacttcatgtaaggtagttagtggtcctgtaagattagaatggaactgagaaattcctgtcacttagtgacatcataggcataatgtcatagtgcaatgcattactcttgtttgtggtagtgctggtgtaaacctattgcactgccagttgtgtaaaagtacaacaggccacgcgtggtggctcatgcctgtagtcccagcactttgggaggccaaggcaggtggaccacttgaggtcaggagttcgagaccagcctggccaacatggtgaaaccccatctctactaaaaatacaaaaattagctgggcttggtggcatgcatatgcctgtaatcccagttactcaggaggctgaggcaggagaatcacttgaacctgggaggtggaggttgcagtgagcaaagattgcaccactgctctccagcctgggcgaaagagtgagactgcatctccaaaaaaaaaaaaaaaaaaaaaaaaaagtataacacaattatatagagtacataatacttgataatggtaataaacagctatgttatatatttaccttttttttttcttttttttgagacagagtttcgctcttgttgcccaggctggagtgcagtgacgcgatctcagttcaccacaacctctgcctctcaggttcaagtgattctcctgcctcagcctcctgagtagctgggattataggcgtgcaccaccacacctggctaattttttgtatttttagtagagacggggtttcaccgtgttagccaggatggtattgatctcccgacctcaggtgatccgcctgcctcggcctcccaaagtgttgggattacaggcttgagtcactacgcagggccctggaatatattcttattttaaaaaactagttaaaaccgactcaggcatgtccttcaggtggcattccaggaaaaaaagcttcgttatcctgggaggtgatggctccatgcatgttactgcccctgaagaccttccagtgaagatgtggaggcggaatatagtgttactgatgatcctgactctgtaggcctaggctaatgtgtgtgtatatggcttagtttttaacaaaagtttaaaaagtgaaaaatatttttaaaaataggaaaaggcttaataggataaggatataaagaaaatattgtacagctgtatgatatgcttttgttttaagctaatcgttactagaaaattcaaaatgtttaaaaatttttttaagtttctaaagtaaaaaatgttaagtaagcaaaggttaatttattcttgaagaaagaaaaatatttttatctttattactgtatatacattgtgccttttctgtgtttagatatgtttagatatacaagcacattgtgttacagtagcctgcagtattcagtacagtaacatactgtgcatcatgctttgtagcctaagagcaatagactataccatctaggtttgtgtaagtccactctgtgatgtttgcacaacaacaaaatcacctcactgtgcatctctcaggaagtttccctttggtaaatgatgcataactggacttgtctgacaccattttaaccttccccctagtcctacctctcattctcaagatttggagaaatcaaaatctaagttttcataataaaaggttaggtatattgggtgttacatagctttcactaatgtcatatctagcagttgtaatcacgtattttaaaactttaaatagtaaattaagaaggaatctttataggtacttgtatgtttcctcaatgtggtttgaattgagcgttttatttaaattactatcaaatacttgagccaaactagcgagacaaaaagaccagaccttttcttttttccgagatggagtctcacactgttgtccaggctggagtgcagtggtgcagtctcggctcactgcagcctccgcctcctgggttctagcgattctcctgcctcagcctcctgagtagctgggattacaggcgcctgccaccatgcccagctaattttctgtatttttagtagtagagatgggatttcactaaatctcgaacacctgaccttgtgatttgcccaccttggcctcccaaattgctgggattactggggtgagccaccgcgcccggccgagaccagacttctgagggggagaaacttgcaaacctgtcagtgagaaagagtgaggtctgattttagatgacagaaaggaatagcttttgtgaatttcggactcccaactactagaattatgtgaatcctgaatgataatcagatgtttactcagttaagtgtttactcaaatattaataagtattgatacattgggatgccatcttatataatgattaacgacacagattctgggtgtatttcagccccagtttcttctgcatatatgatagtaagtgccttcaaacaattcttgacacattaaaggtcagaaaatgttagccgtcattattgcttagtacaaacctgagctaggaaatactaacagagagctctttgtgccactgagtcctggaacttccccatactaattttgagaaggctttcttgtaagtatgtgacagatactgtttcctccactttctgtttattgcatataaccactattcttgtatgtaagtacgtataacagtttctttactattcccattattcagcgtttataatctggtttgacatatcagtgttggtgctgagagggaaaggtatttctaggtaggataaaatggtgaaaagtgatttaacactgttgtatgcttgcttttggccaggaactatagggcagtgtatcttaaactttgagtcttgagaccctcttacactcaaattctccatatatgtaaagaattgaaaacgagcttttatttatgtgaggtatttaacaatattgcattagaagttaaaactgagaatttaaaaatttctgttctcggccgggcatggtagctcacacgtgtaatctcagcactttgggaggccgaggcgggtggaattgcttgaggccaggagttcaagaccagcctgggcaacatggtgaaaccccatctcctaaaaatataaaaaagttagctgggcgtgatgtcacatgcctgtattcccagctacttgggaggctgaggcacaagaattgcttgaatctgggaggcagaggttgcagtgagctgagattgcgccactgcactccagcctgggcgacagagtgagactgtgtctctaaataaataaataaatatctgttctttaagtagcaacatattacattttagcataaatgttttttatgaagataacttttctaaagcaaaaatgtgagaagtgccatcattttatgcaaatctaatgtctttttaacagaagacagctgaattcacatctctgttttgtttcagtcttttgataccttgttttagttgaatatgaagaaagtctgtagtcctacagatacgtagttagaaaaaggaggagtagtttaatagctgttctagataattgtgggtattctctgatgtttataccaaaaatcagcaagtggtggttttttaaaggtgaattttaaaagagatgtggaatctgaaattatatccatgaatttttatgttctcttacattaaaatccattgatctttcttgtactttaaatggatcttacacatgactttataatacgcgttgttcatttggataatattgattcagctgagttatgcagatgtccagatgttgaaacagcttattatctaatacagtatccagaaatgacatttgttaatgttacaagatctcatcagaagagtccttaattatggagaagctgtcagattcatggtgctgattacaaggtttctagaattttagtttgtaacttgaaagcttgaattttatcattggcaacaagtactgtcagttgttttccttgaaatgacagggtcactttgttcatgttcacgtgtatctgttgaatatctaagtctgaataaccatagtttgtcagttaatactttccagtaaaagtgtttagtgaaaaaaagtgtctaggtctgcttggaactaaaacagtcacaggagtgctttcctttgcgacaaccattgtactttgggatggagcaggagtgctttgtgggcatttccattttatcatgtagattattaaagagatgtattcaaagattgaagtttaataaaattgatcatttgtactgctttaccaaagggcatacatgaagctgccttttttgtgtttcactgcatgtgtgttgcaatgaacaacacagtgactgactaccagtggggtttggtgccactgacttggtgtgtactgagacacttaacagttttacccatccttgcttttgtattatcaaagcagatgtcagtgcagtggaaaaaaaaaaagtcctttattcctgaaatgtctagccctcacctatatctgtcacttttcttcttcactcttttctcattatacttgctatttgtttaccaatgtacctgaaatgactttttacttatgctttgtgaattcatgaaagccatgggccttctcagaaaaatatttttacatatacacaatattacagacaatttgtggtactatacagagccactaaaggccattttggtctctgaatccacgttagttattcttttgttttgagacggagtctcactttgtcacccaggctggagtgcagtggcaccatctcagctcactgcaacctctgcctcccgggttgaagcgattctcctgcctcagcctcccgagtaatctgggattacaggtgcgcgccaccacacctggcttattttcgtatttttagtagagacggggtttcagcatgttggtcaggctggtcttgaactgacctcctgatccgcccaccttagcctcccagaatgctgggattacaggcatgagccaccatgcccggcccacattaattattgttaacaggcagtcctaagatgagagggaagtacagcagctgcctaattttttttcacttaaaaccgtgtgtgtgttgtgtgcatagagaaagatggggaggaaaggaagacagagtgggagagggagaagaaaagcaagagagaaagaatgaaaaagcaaagggggctggacgtggtggctcacgcctgtaatcccagcactttgggaggccgaggcaggcggatcacgaggtcaggagatcgagaccatcctagctaacatgctgaaatcccgtctctacttaaaatacaaaaaattagctgggcatagtagcacccacctataatcccagctactcgggaggctgaggcaggagaatggcgtgaacccgggaggcagagcttgcagtgagctgagattgtgccactgcactcgagcctaggcaacagggcgagactccatctcaaaaaaaaaaaaaaagagagactccacattttagccaattgtagaatttttatttttctgcctttttgttgcttaaaagcaggcttttgtgctaaatatggagaaaatgctaggaaaaaattaggatgtctagatttaactgccattaattagtatgtaatcttgggggtgggggttgagtaagagttagaataccagtggtcagtgaagattactaagattttatgaggccaaggcgagtggatcacttgaggtcaggagttcgagcctgggcacatggcgaaaccccgtctctactaaaaatacaaaaaattagctgggcatggtggcacacacctgtaatcccacctacccagtagattgaggtaggagattcacctgaagccaggaggtggaggtttcagtgagccaagatcatgccattatactccagcctgggtgacagagagaccctgtctcaaaaaaaaaaaatttatgagacaccgtgcataggtgttggaattagtgcttttttcttgccatcttttctgttttagagaggtaatgataagtaagaacttgctggggaaagtagcataaggttagtgaaaagtaaaatttagtatacacacaacacacagacacatatatatcacatacccttggatatgtgcgttggaaagacaaacctgcaatggaaaagtttttacactgatataaaatgtgaaatataatggttgagtaaaggacagaattcttttgggagaggatacacattttgcttaattgagattcaaagttaatgttctctgtcatcaaaactgattgcaagtggtcatctcttgatgctgatctgtagtgagattctatgtatttcatcttagaagatgtctttttacacagggacatactgcatattcatcacttggaaagcatttatagaattctcctgatacttgcctttcagcatgtcattacattgcagattaatcacttccagtagagggttaggtggaagctcctcggctgcacagttaaatggattttgatatatggaaattttttttgcgcttgagtcaaggtttgaagaatgctagtttgagtttgaaaaaatgtatctgctgcaaaattgtgtgggaatgaagatctcacttgtcttaacttggcagcacgggttatgtataaagcagtttgctgactgggtatggtggctcgcgcctttaatcccagcactttgggaggcggaggcaggaggatcacttgagttcagcagtttgagacctgcctgggcaacatagtgagaccttgtctttatagaaaattaaattagccaggtgtggtggcatgtgcctatagtcccagctacttgggaggctgaggcaggagaatgtcttgagccagtaggctgtagtgagcctcattacaccactgcactctggcctgggcaataaagcaagaccacatctcaaaaagtaaaaaattaaaaaataaagcaacttgctttaattcagacagtattagttgtcagaatgacttaccacaatggaagtttctcatatatttttttgccttataattttaggctgaatttattagaaaacatttaggggagctttcattctattttgtagaatagaggctacctcgaattaaaaggggaaaaattactagatctgccgcaaaatttaatttctaaaactcttctgtgtttggtaatagtgattgagggtggtggttcttgtttagaaaaaattcagtatcagccctgaatgcaaataaattacaataaagctgtcactgctaagccatcaaaatcctgtgtggttggccaaatgaggatattcagcttttattactaacaaatagtcatgtaactgacagtggttaagttcattagagcaaatgaagttgaccattgatgcctgtggttcagtaatacctgattaagatatttttccacaaaaaaactgcaccagacttcaaacatcctacattttctcagactttgtaaaatagtccaactaagtatttttctactttaccatcatcagttgtgacatatcttagcagattacacttcaggttgtactaaaatagtttttctcagctgctttgagaatattcttgcctctagttgttccacatagattatttatagagggtaacttttcagtcacttcgaatgaggattggctccccaaataacaagtattggtaatacctgtcatcgagagccaaggaacaccactcagaaccatttggcttgttttttaattgtttactaattttgctcccagtgttctcaactcttcaagcaccgtttttacagaaaggctaatggcgtttaaaagtttattgtctcagctggggtggtggctcacgcctgtaatcccagcactttgggaggccaaggcaggcagatcacgaggtcaggagattgagatcatcctggctaacatggtgaaaccccgtctctactaaaaatacaaaaaattagccgggcgtggtggcgggcacctgtggtcccagctacttgggaggctgaggcaggagaatcgcgtgaaccagggaggcagagcttgcagtgagccgagatcacaccactgcagtccagcctgggcaacagagcaagactccatctcaaaaaaaaaaaaaagtttattgtctcaaaaaatacatagttcttcagcttttccaatcagatacaatttaattaacccaccattgataaatgacttaacttggctaacaaatgggccacttggaaacttgagttgcagactcatttttatttttgtgaagaaattctgctgtgatgagatttcattttaattttttaaaaagttcccttaccattgctttactatgaattgggaatgctgtggtgagtgctccatctggtaacatcagtatatgttgtggttttttttttagcacagctacataatgactacaatgccttagcacccaattaaataacataatccacactttattgtgtcttaaaaacacaacattcaaagttcactttttttgctttgacatgatgagtatgcactggtagtaaaagtaaataaaatgttgcagtacagcaataatcgtgacacccatgacgctgccaggttgtaactgcatctgtataatttgtgatgcaccgaaaagcagtgtgaagtgatgagagtaccatatgtagtccatcacaactgctcagctctgccattgtagcatgaatgtgtccagtgataaataagtggctatgcttcattaaactttatggccaccaaaatttgagtttcatataatttttatatgtcacagaggattcttttgttttgcttttttgcaatcatttaaaaaatgtaaaaaattattcttaggcccctagccatgcaaacactggcattgggctagatttgaccccttggccttagtttgctgaatactggtgtagtttttctgcctttcctaatgtaaacatgattgtagaaagataaccttactggaagtcaggaaaccttggtgctcccaccaaagttgtgtgactgattaagtcaggtgaaataaattgggattaggagccatggtgtctagtccttgacaagtcattcctcaatttttttaatgtaatcacctgaatttctagtgtatgcataatcacattttgtgtgcctctcggcagccattccattgttgaagaggcagccaacacagaaaattgttgaggggttttgatctttgacaagggaagcgtatagtgtgagctcaccagtcaccctggcttttttccctggagacatttcctagtttgtggcataggggaaatagatcccaaataaaaagtgacggtctcactgggctaaggaagaaaggtggaagtttggggccactaaagcaattgaagcttaagtccaggagaggagagaaccacataaaatctaacctcaaaatctgcagtcaggtccctctaaagtcattgactgacttcagaggtacacataagcaagagaagaaacccagcagaaaacagtagctgaaaagctaaagatctgagcagacatttcagtatctaatgccagagaggcaaaaatggaagttcaaatcctgccaagttagaggggccttattacaccctgagttttccactgtggccccatcatgaccactgcctaagattgaaggcaaaactaaaacagaccagccctcaggaaaatgagttactgctgtgctgctgctaaaaggaaacagccttctttggagaaaggtattatctaaaacttctacaattttgtatccataattcagtatttcattcaccaaaataggatatgctgttttggacaagctaatgaaactgaattgaccaaaaaccaatagaaattatctagtgctgacagaaaaaaaaaagtgtacagaagaaagcatgagagacttatgtattgctgatagacagtggaaaggtctatcatgtataataggaatcccagaaagagaggagatagacatacaatgggatggaaatattgactaataattttccaaaacagagatatccaagcacatattaaagaagctgtgtgattccaagcagggtaaatagagagaaaaccatattgaacatagctgctagaaatccaagagaaagagaaaatgttaaatgctgtcagaagaaaaaattcattatcttcagggaacaataatatgaatgatggctgatctatcacctgaaactgtggaagacagaagacaatagaatggtgttctctttaaagcactgaaagaaaaaaaatgacaacctagaattctttatttattttgagatggagttttgctcgtgtggccgaggcttggagtgcaatggcgtgatcttggctaactgcaacctctgcctcccgggttcaagcgattctcctgcttcagcctcccgagtagctgggattacaggcatgtgccaccacgcctggctaattttgtatttttagtagaggcagggtttctccatcttggtcaggctggtctagaattctaaatctagaatatccttcaatagtaaagtaaaatgaagacaaactaaagctcagaaaatatattgctgatatgctgacactagagaatattaaagcaagttctttgtgttgcaagaaaataacagataaaagcaaagaactgcagaaagaaatgaacaatggtaaggataaatgtgagtaaatacaaattctgactgtttaaaataatagttgtggcttgtgggatttaaaatatgtggaaacaaaaatacgacaactgtagaacaaaaggctggaggcgggtggtaatcagtcaaaagtgtatttgtaatctctagagcaacctctaaatgaaaaaagaatatataacgaaaagctaatagaggagaaaatggaatagtaaaaaaataactgattactccaaagaaatgcagggaaagagagaggaatgaagaacagatgggacaaacagaacagatgacagaatggtagacttaaactcaacttcgtcgatgattatattaaatgtaaaaggagcaaatattggctgggcaccgtggctcacacctgtaatcccagcactttgggaggccaaggcggacaggtcacttgaggtcaggagttcaagaccagcctggccaacatggtgaaaccctatctctactaaaaatacaaaaattggctgggcgtgggtgcctgtaatcccagctactcaggaggctgaggcaggagaatcgcttgaatctgggaggcaaaggtttcagtgagctgagatcatgccgctgcactccagcctgggtgacagagtgagactccatctcaaaaagaaaaggagcaaacattgaaattaatgcaaagctcagaagacctaactattatagatactgtttacaagggatgtattttaaatctaaggacacaaatgaggaagtaaaaaaaaggggggggggaggggggtgtgggggagacgatatcatgcacacattaatcaaatgaaagctgacttggctatatttatgttggaaaaagctctaaaaccagaaataacactagaggtaaagaagggcattatataatgctaaaaggataaatttaatggaaaaatatctaaaatttttatatatgtaatagtataggtctaaaactaaaaggaaaggttgacaactattataaaaagttaaaatagacaaaaccacaaccatagatcagtgcccctctttcagtaactagtagaacaaacaggaaaaaatcagcgaggataaagatttgaacaacacagccaccctgacctacttggcggacatagaacacttcactcaataatttcaggatatatatgcttttcaaaatatgtatgaaacatttactaaaatataccatatgctataccataaagcacccctcagtacatttgaaagaaatgacatcacagatgtcagccaaaatccatttaatgaaaaacgtgaaagactgccatactagagtatataacattgctgagagaaataaataaaaggagagataccatatttgtggattggaagacttgaaattgtgaagataccaattctgtctagacttacctacttattccctgctcccccccccccaccctttttttttttttttgaggcagagtttcactcttgttgcccaggctgcagtgcagtggcacgatcgtggctcactgccacctctgtctcttgggttcaagcgattctcctgcctcagcctcctgggtagctgggattacaggcacctgccatcacgcctggctaatttttgtatttttagtagaggcggagtttcaccatgttggccaggctggtctcttcctgacctcaggtgatccacccacctcggcctcccaaagtgctgggattacaggcatgagccactgtactcggccttattcccaatttaacacctcacaagtttgggggtggaggggctagacacaagccaattttaaaacatttgaaagttcaaaaggaaaatctaaagaacaaaattgggatgtttatattactagataccgagactttataaaaagccatagtaattaagacattgtggtattgatgcaaaaatagacaaatggggtaatgagctatatagtggctaaaaacagacctgttcctgtatggtcacctgatttttctacaaagctgccattgcggttcagtggggaaaaggatgatctttatgataaatggtgctgaatcaactgggtatctgcttagataaaaaccttgacctttacatcaaaccatacacaaaattaatttgagatgggttatagaatgaagtgggctaaaacaataaaatatctggaaggaaacataaggaaatatgtttagagaaggcaagaatttcttgaataagatgcaaaaggccttaaccaaaaaaagattgactaagattttttaagatttaaattcattaaagaacttctgttcatcaaaagatagcatgaagagatggaaaaagtccagttttaaagaatgaacaaaagacttaaaacgaacttgtccaaaaaaaaaaaaaaagataacctaaagggtctattaggcacatgaaaaagatactcaatggccaggtgcagtggctcacgcctgtaatcccagcactttgggaggccaaggcggggagattatttgaggttaggagttcgagatgagcctgagcaacatggtgaaaccctgtctctacaaaaattagctgggcatggtggtgtgcacctgtaatcccagctgctcaggaggcaggagaatccttgaacccgggaggtggaggttgcagtgagccatgatcttgccactacactccagcctgggtgacggagcgagactccatctcaaaaagaaaaaaaagggtacttgacaaccttggtcctcggggaaatcaaattaaatccaacgaataccaccatatacccaacaaaatgactaaaattaaaaatactgataatttgcagtatcagtaaagatatggaccaacagtgttaggaggattatgaattggtatagccactttgggaaactgatggtatctactacttaatgaaataaactgacccgagcagttctactgctttgttctatacatacctaagataaatatgcccatggatattcatagcatttgtaatagccccaaactggaaataatccaaatagagtagtaaagatattgtcatatgttcatagaatggaatacaggttgaatattttttatccaaaatgcttgggaccccaagtgtttggaatttggatttttttcagatttttgagtatttgtattatacttaccagttaagcatccgtaatctgataatctgaaatctgaaatgctccaatgagcattttctttgagcatcatattagcactaaaaaaggtttcggttttggagcattttggatttcagattagggatactcagcctgtatttcaaatgactgttaaacacaattatatggatgtatctcacagatgcaataatgagcaaaagagcattcttatgtttctttttatctaaaagtctaattcacaaatacatcaaatcaatatatactgatagcaataaggatagtaacctcaggcattactgtcattagttagggtacaagggaatcttcagggttgcaggaagcattctgtaccttgatctggatgatggttactcaggtatatagatagtttaaaattcgttgagttacacccataaagttagtatactatatgtatgtaatatgttaaaatattttctaaacagtagtaagtatggtagatatttgctatcatgggattttatctggtctgaaattactacatgctgaaaatttctaggaaatttttgatccaaaaattttatgtggtgaagtggaaaaagtactggcctttaagttagaagactaagtctgaatccctctctgctgcttctcactcctatcagtcttataaaacctgggcactgtgatcttatgcgagttattgaatctctgtcattgtacagtggaaagaatagcttctcttttcagttcctggggtgtgaaaaggattaaatgaaatgattgatgtgaaggtgctttgcacctaatgaagtatgctgatttataatatttttataatccagcagcgttcagatatccaaacactggaatccctcatggatgctgtgatagcagtctagttgccctgtgtaacaggttgcccggatgatttcttcctttttttcagaagtcttgagagtacataaaggagcaggacttttgaattggaagacagctgggattgccctgggacatctgccttattctgtccaacctttggctaatttatttctaatttctaaaactcttgtcagagttttaaacattgggaaaacctttagcttctctaactgcattcatcaactcttaagatgtgactgattattaaatgcacttttatgtgccactaagttggtggggggggctgccaattataattgtaagaagcttttaattgcaagagtctcacaacttcagagatattagttaagggagaaatgtgcatcctacagttagtgaaaatataaaaagtttctgtgcagtgtgtttttggtaaatttttagtttctgtggatttgcttgacttacaagttgaagcactttatagttctgtaaaaatgttacacaattacttgagaagtgaaaattatacagagggaataaaataaatactaggtaaaatattcaccactgtcatttgaatattttaaattgacatattgaagtgacccacattagtcttttgacttagtagtcaagttacaactaagttttgataatgtactgttcttcttgttcattgctgttctctataaacaactaatacacagtagactctcaaacatttgttgaatgagttaatacagtttgtaagtacttttagctgtgtgtttgttatctgaaagcagtttgagacccttaattcttccaaggcgaatactttttttttgagacagaatttcgctcttgtctcccaggctggagtgctgtggtgcgatctcggctcactgcaacctccacctcctgggttcaaggagttctcctgcctcagcctcccaagtagctgagattacaggcacccgccaccactcccggctaattcttgtatttttagtaaagacagggtttcaccacgttggctaggctggtctcaaactcctgacctcaggtgatccacccacctcggcctcccaaagtgctgggattacaggcatgagccaccgcacctggtcacattttttttttcttaaactaaaatcttccacatttaaaactaaagctgagatgtctttttggtgttagaaaaacccaaatatgcatcagaagtaggtaattgatgtttgagaacaagcactaatgaagctatatcagttcccataataaaagcagttctgctgatcattgttttgaatttcagggatagtcttataaactagcatatttgctaaagcacatttgaatgttgtctgtgtctcctgtttattgcctcctttttacttttatattaatatattaatggaatatatagcttttgcatgtggaggcctttttttttttaaagcctcttattgacctgacaaaggaatcagcaatttttagcaagaaatatgtggaattttattttactttggagatggggtctcactctcacccaggctggagtgcagtggcacgatctcagctcactgtagcctctgccttctggggtcaagtgaacgttccacctcaacctctgccttgagtagctgggaccacaagcatgcaccatcatgcccagctaattttttgtattttgggtagagatggggtttcatcgtgttgcccagggcgatcttgcgctcctgagctcaagtgatccacccaccttggcctcccaatgtgctgggattacaggtgtgagccaccgtgcccggcctttatttttattttgcagagacagggtcttgctctgtcaccaagactgaaatgccctagtgccatcatagctcactgcagcctcaacctcttggcctcaagcaattctctactatgctaggctaattctgttttttaaaaacatcttttgttgacacagggccttgctttgctgcccaggctggtctcgaactcctggcttcaagcagtcctcccgctttgaccccctaaagtgctgggattacaggggcaagctactgctcccagcctattttcttttcttaaatgctctttcacttaagattaaatgagagctcagctgtaaatttaaggttaaagggagtcaggggagatggtgatgagaggaaatgattacaagttgagttcagtggggcaaataaggaactcttctgtctctccatgcaacattctgttccccttcatcccacaagttactggaaaccatattatcttatggctcagtaatgcaaagatgcctcactccatctaaatagcctttagaggttttaatataatgatctattgggaatgtaacgataagttaatttttaatacatagctgatatcttttttgtatttcttttgatcagaaagtagagataggagttgctaaaattttggggactgctggtaacattccaagaaagtgtgtgaagctaaatcacctactgacaattactatttaatctccctttcttcatagcacattgttcttaatgaggctgttttgacatcctactagatgcgagataagcaggccagaccttaaagggtgcgggctctgaaatgtttttttgtgtgtgttttttttgttgttgttttttttctgtttgtttgttttttttttatttgagacggagtctcgctcttgttgcccaggctggagtgcaatggggcgatctcagctcactgcaacctctgcccccgggttcaagcgattctcctaactcagcctcccaattagctgggattacaggcatgcgccaccacacctggctaattttgtatttttggagagatggggtttctccatgttgatcaagctggttttgaactcccgacctcaggtgatccacccacctcaacctcccaaggtgctgggattacaggcatgagccaccgtgcccggccctgaaatcttttaagtctctttggctactaggccccaggttggtcacaggacagcaaaaaacaggactgcatttcatcaacagcagacttgaggagcatcatcaggaaccagtaacaatgaaaatagaagtcagagatcatagaataacattattttaaaccatgggaccaaatagggtaatttgctgcctgtgtgacttttctgatttttaaagtatgggcatgactctttttgaaagattattatgagtaaattttagaaaactgactgttttatttatcgtttgtcagtacgaggatgtcgtccaggaaagattgtgcagatgactgaagcagaagttcgaggcttatgtatcaagtctcgggagatctttctcagccagcctattcttttggaattggaagcaccgctgaaaatttgtggtatgtaaatgggtaaagttggaaacaactcttttgaatcatgtttttcctcccatgtttaagatctagagaaaacattttttgaaatttttgtataaaacagatcagtaggctttactaaataaaagtgtataaaaattgaaacttataaaaatgacaagttacagacaagatgaaaatacttgctatatatcaacagataaaaggagttctatttataatatataaagagttcttataaataagagaaaggcgatacagtataaaaataacataggaagaggaaggtcttagaagaaattcaaatggccagtaaacataaggacgtcagcttctttttttagtaatcagtgatgtgcaatttaaagcaagtctccaactctagtcagattataaaaaaataccaaagattgatgtttagtgttgtcaaggatgtcacgaaaagggcatcatagtacactggttagaaaaaaataggtgtataatttagagggtcaatatggcgatatctgtggtcttctaactttgatgttatttaaatttgttttgaagattatactactttataccttgtattcttttaagttttacagtgacttttttacagtcctttgtacagtgcccagcaaataagagatactcgctaagtaaatgtttgttttttgtttgtttggttggtttttctttgagacagagtttcactcttgttgcccaggctggagtacaatggcacaatcttggctcactgcaacctccacctcccgggctcaagtggttctcctgcctcagactcctgagtagctgggattacaggtgtgagccaccacgtctagctgactttttgtatttttagtagagacagggtttctccatgttggccaggctggttctgaattcctgacctcaggtgatccacctgtcttggcctcccaaaatgctgggattataggcatgagccaccgcagctggccaataaatgtttgttgaatggatcagttaacttagaatatcacaccttcaagtaagaggtagtagttcagaatttgggggaactaatcaatcccctgtataaacttaagcaaatgtagttacttagaggtgatcttaaaattattagaattaaagtattctttgaaggtgttctttaaaatgtaatatagaaataacttgaaggtaatggaagttatttgtactacatatttctaaaggtttactatttgtctccatatttggtgttaaaaagtgacgtaagttaaactaccagataataaaattgttttagttacctattgttgtataataaatcattccaaaactttgtggcttacagcaacattaatttaccatctcacaatttctgtgggtcaggaattcaggaacagcttagtgggtcctctggctctgggtctctcacaaggctccaattaaggcgtgatctcgggctgcagtcatctgaaggttgaactgtgaaaggattcagttccttatagactgatggactaagagcctcagttccaaatgagctgttggtcagaggcctccctcagttctttgctacgtgggatgcttcattagacagctggtttcatcagcgagcatggaagaaggtgagagagtgcaagcaagatgaaagtcacagtcttttgtaacttaatcttggaagtgacagcccatctcactttcgcttattagaagtaagtcaccaaatatagcccatactcaagggtaggggaggattacacaggatgtgaacattgggaatcatttcatagaagctgcttataacagtaaccaatttttctaaaactgactctttctctttttaggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgtaagtgaaaataaagacttagaaaagtaattcatggaaacattgcctaataattttctggttcagaagagttgctttgattcagagttttttcaaaataagatctgtcaggcataggccaggaagaggaacctgaaactgggaaacatgttactaattaaattggttccttgagatctccttggtcatatttcagattgactgcagcttacttggctgaagaggctcttttaaaattagtttatctagtaaactatccaggtgaaacagaagtcactgtaggcagtggcccttggttttctagtgtccattaaggttttaactctcggcattcttgtggtatgacagcttttattagtcctgtgtcacaagaattattgagaagttctgtgaaactatttaaaagtcaaagtttaatattattagaatttaaatctatgtctgtaaaccttgaaagataaagatactgaatactctggggtatccttattttactctctttttcattagtaggaaatcaacgatttggtattgtatgtttccaagtgttattattaaaataccctactaggttcaaatatggtcttttggttttattagaatacgggagtaagtatttatttggttaattactacttagaatcaattataatcttcaaattgaattttttattgctgtcttccctattagaatctacttttgctttttttcaatccttaattatgttagagacctattcaaactcatatctccttgatttatataatgatttgacaaagtttgagggtatgttatatgtgcaggcactattgtgaacacagtgcgtgaagcaatacacaatacagatgatctctgttctcatggagcttacattttttttcccaagtgtttctccagcattgattggccttccctgtccagccaaatagcaggtcatcagcctagctgggactgtatgtccttgtagtgaaaaaaggctgtatcaggcttccaatgcttaatgaaaatagcctttcttttttcttttttcttttcttttctttctttttttttttttttttttttgagacggagtctcgctcttcttgcccaggctggagtgcaatggcacgatctcagctcactgcaacctccgcctcccgggttcaagcgattctcctgcctcagcctcccgattagctgggattacaggcatgtaccacgttccctggctaattttgtatatttagtagtagagatggggtttctctgtgttgatcaggctggtcttgaactcccaacctcaggtgatccacccgcctcggcctcccagagtgctgggattacaggtgtgagccacggcgcccagccatgagcttacattctaatagaaatgattctgtatttgattttgtattgtatttttatttctgagatgtagtgtgtggtttgaattatttaaatcagactagcagagagaaagtgggttggagtacatcaaactacaacattcttcctaaagctacatcagaaatggaggtatatttttaaaggataaaagataggcaagaatgtctttggggatagaaatgacatcaaatgaaataatgtatgggagagcaacttgtaaacagtgctttgagttatgtacttactcattaaggggcaggttgtggcataaaagcacaggaagttagtacttgtgtctttcatcccttccctagcttagtagttgtaccttattaccaaattcaggaaaatcgagtaactctaaaaaggtgaacatacacttgaggttgtctttgtcgtagctttttatgctaggctacaggaaaattatagcctttgtgcctctatttatacttgctatagtgccaagttgtaattcacacaaaagaatactagttaaacacttggaaattttccttccttggcaataagtttatactgtgttaatcaatgcattagtgttaaaatggacagtttccagaggcaccttttcacttctgcttgcttatttggctaggtatttaactagtccacacactgaacggaaaaaaatgaactaagagcctattagactgtttaaaaattgctatattatactgatcttaaaagacaaaaattgtttgatgtatttcataaaacacctagcacaatctttgggattttttaagtgttaaatttgattaggtttattttatttgtcagaaattctatgtatttatgatgtacaacatgatgttttgaagtatatatacattgcagaatggttaaatcccgctgatttaacatatgcattacctcaaaaagttagcattttgggagaaaacaacacttaaaatttactcttagcattttacaaagatacaatatagtgttaactgtagtcactgttatacaatcgatcttctgtatttattcctactacccaactgatactttgtattctttgaccaacatcttcccatcccacccctacccccagcacaatctttgaagtcttggtaactttactgaaggtattgaatgtttattgtagttgttgcctttttgaaagtacgtaaataacatctttgcattgtagaaaaagttcttctttatagataaacatgaagaaatgaagaaaattgaaatcattcataatcctgcggctttgagataactgatgagaacagttttagattttttaatttattctatctgttctttttacaggcaaacgaagatttaatattaaattgtggaagaccttcactgattgttttaactgtctgcctatagcagccattgtggatgagaagatcttctgttgtcatggaggtagactagtaaatttgccttacagattttttttttcttctattattcggaaaatacctataataatcaagaggctgtgggaaaacaaagcagtgcttgtatgaaaactcaagtgattaaaactgttttaaacatggctaaacctcttttaaaaattagaaatttatttataaatgaaaacgtaatgcttctttaaatacagtttcacatataaggagtgtaactagagttgtttgagaaagtctcctttgcctcaagttttaacagaaagacacccctgctatttattagtaaaaatgagaggatatcttcctgcctatattgaaatctttcatcagaatccaaataaaattgagtttcatattcacatatatcaagaattctaggcttcatataatatatttgctttagtattaacaataaaataataaaataatctttggcagattggtaggttactctgtatggcttatgaaataagcttgaagttttttgaaagtttatttgaaaaattaatgtatatgtctaacacctagctagtagatagtgtatgatctgaccatcttgaagagttaaaaacctgttgctaagatacatttatgaaacagataattgagtaataaaaggtatttaatatgtcagaacttattaagacactatgagaagtcaggaggaggaaagactgggtacatgtgtgtatggaggcatgggttttagaggataaataggctttggagaagttaaaaggacttgagacactctttgttgtctagtttagggaatgtgtaagaactggcctgactagaaggtcaagtacatgctgggaaatgatggaatcagattatggagatttgactattgagcaacggagtttgttgagtgatttaataaccgtattgggtttttgtacagggaagtaatttaatggaaatagtgtaagaaaattagtttttcatcaatatacgggaagaattaaagtggaaaaacgctgaaaagatagatgcacttgcctaggcccgaggtaataaatggtttattctctggcagaacataattcactatattaattgaaatatgttttccagtagacattaaacacgtaatgaattgtagttcttgtacattagtgtagctaaggatagaagtgtagcagtatggatacgaatgtttagcttcattccttgtgatgatacttggattgcctatcagagagaaataatagcttatataccacttcaaagattgcagagtatttttatgagcttttcctgttaatccttctgatcaatagtttatgacttcatgaagataatgaacatgttggagtgggatgtgaaaagaaggtcttagggaaccaagtgaggcactttcacttagaagttaaaatgtttaagattagtggtaagaactggcaaaagtggtaggaagggttgcagttgattatgtttctatgaaggccagggaatgattggaaaaaagaatggtagttttttttttccttgggaagtcttttgaaatataaaggaatttcatttccctggtagggaaaaatggaaaaaaacaattataatgctgtattatatcaaagtggaattcctaataactctgtgttgccctttaagacattaaaaggggcagggcgcggtggcccacgcctgtaatctcagcactttgggaggccaaggtggttggatcatgaggtcaagagatcgagaccagcctggccaacatggtgaaaccccgtctctactaaaaatacaaaaaattagctggatgtggtggcgcgcgtctgtagtcccagctactcgggagactgaggcaggagaatcgctcgaacccgggaggtggaggttgcagtgagctgagatcacgctactgcactgcagcctgggtgacagagtaagattctgtctcgaaaaaaaaaaaagacgttaaaaggaacacttttcagtatctttaatttcacatagtgaatctattttgattaaatgctttttattcggtgactgttaaaatattaaaatttttagctgttagtactatgtctcatctttttatttataggattgtcaccagacctgcaatctatggagcagattcggagaattatgagacctactgatgtccctgatacaggtaagtgtagagagaagtttaattgttttgtgtaaagtgttttcatatttgaacttgattacatttagtggaagtaggattggcttatgtaataaataaaagagcttttttcatagtcaataagccagctacagattactttatttgcagtaatacacaatttttcactttgcactgatcctcaaaatgcggaacctttttatttatagtcataatgtagttatttgatcacaaaaaagattttgctgttgagtccttatacctatttttctaaattccctcattcatactagcattggttatgttcttcaaaaatttgttaaattagacaaaagttttttaattaaaataatctattctttgcttcttaggcaaggatacaactaccttcttttcaaatgtctagtagttttttgttattttctatgtcctctatttgaaatttttagagctttttttcaagggggtgtgggagggatttcaatctgttgcccaggctggccttgaattcctaggctcaagcaatcctcctgcctcttctgagtagctaggggactccaggcatgtgccatacctggcttaaatttttagagctcttaaggctctagagacctgtggtcagttttgtgaaaattacattggaaatctctgggaaggctgggagcagtggcactcacgcctgtagtcccagcgctttgggaggctgaggtgggcaggatcacttgaggtcgggagttccagaccagcctggccaacgtgatgaaaccccatctctactaaaaataacaaaaattagctgggcatggtggtgcgttcctgtaatcctagctactcaagaggctgaggcacgagaattgcttgaacctgggagacagaggttgcagtgagccgagatcacaccactgcactccagcctgggtgacagagtgaaactgtctcaaaaaaaaaaaaaaaaagaaaaaagaaacaacaatcaccacaaaaaatgctgctcagaactacacatcaaccattataaatggtatagatcctctgatgtcagtagccatgtaatacactgtatgttgtaataaattgtgttaggagcttttttttttttttttttttttttttttgagacagagtcttgccctgtcaccaggctggggggcagtggtgcaacctcggctcactgcaagctctgcatcccgggttcaagtgattcttctgcctcagcctcccgagtagctgggactacaggcgcccgccaccacacccggccaattttttgtatttttagtagagatggggtttcaccatgttggccaggatggtctcgatctcttgatcttgtgatccacccaccttggcctcccaaagtgctgggattacaggcgtgagccaccacacctggcctgtgttatgagcttttttacataacacgacttgttgtgttgattattttttaaagtatgcattttatcacagtttttgattgtaattatagaatacatttgactaaacctaacaaactggtatttaaatagtattttatttaaaatgctgtttttaggcctggtgcactagttcatgcttgtaattccaacagtttgggaggccaaggcaggaagatcacttgaggtgaggagtcgagaccagcctgggcaacataacacccatctctacagagaaaaaaaaaatttttttttttaattagccacatgtcgcagcaccgcggctactcaggaggctgaggcaggaggatcacttcagcctgggaagttgaggctgcggtgacctgtgattgtgctcctgcattctagcctgggtgacacagtgagaccctctctttcaaaaaacacccaaagtgctatttttaaaataaggtataatataaatatgtattactggtcattcttcagaatatctgtttatagttcagatgtaaactgatctagtgtgatatgctaggcttctgtttttagcatgttttatttattttagcgtattttaatgagaagttttcaagatgctgaaaacagttattttgatctttgatagtgtctgcaacattcagaaatttaatttataagttaatacattatttgaagcagcctagttgattgtgatgctagctcattaaacaataaatcttgactctgaaattctttttgagacagaatttcactcttgtcgcccaggctggagtgcaatggcctgatctcggctcactgcaacctccacctcccaggttcaagcagttctcttgcttcagcctcccaagtagctagaataacaggttcctgccactgtgcccagctaatttttgtatgtttaatagagacagggtttcaccatgttggccaggctggtcttgaactcctgacctctggtgatccgcccacctcggcctcccaaagtgctgggattacaggcgtgagccaccatacctggcctgaaattcttatctagaccctgttaaggttaaagaattccagattgttgttgctaccattatttgatttttttaatgcatccagagtgtcatgtttcctaaacctcaaactctattctaattttatacagttttattgtctcactgaaattatagattcttgagatcgagaccatcctggctaacacggtgaaaccccatctctactaaaaattcgctgggtgtggcagtgggcgcctgtagtcccagctactcgggaggctgaggcaggagaatggcatgaacccgggaggtggagcttgcagtgagccgagatcgtgccactgcactccagcctgggtaacagagcgagactccgtctcaaaaaaaaaaaaaaaaaaaaagaaattatagattcttaataccttagctttctactggaaagaggctggaaagtatgaaagcattattaagcactgggtgggtgtatattttcgaagagtcagcttcaaccagaaagggcttaagaattgagactgactattccagtggattttgtgtgctagtgaatttcttaaaacaacatacagggagcttgggatatatcaatgatagagattgaatacattgccactaattctacaaatggttttataatgcctctatcaagatatgatgtactgtaactgaaaatgaagatgccctttcctcctaaaccatactatgatgtttatggattatttaaaattcttaaaactgacttaactctttaaaaattatcttcttggctgggcgcggtggctcacacttgtaatcccagcactctgggaggccgaagcgggcggatcacgaggttaggagatcgagaccatcctggctaacacagtgaaaccccatctctactaaaaatacaaaaaattagccgggcgtggtagcgggcacctgtagtcccagctactcgggaggctgaggcaggagaatggcgtgaacccgggaggcagagtttgcagtgagcagagattgcaccactgcatcccagcctgggcaacagagcgagactccgtctcaaaaaaatatatatgtatcttctcttagccactgcaattcttagaaaatcaccatcaccatctcaacatccacccttcttttaatatcactacagttggacttttacccactccgttaccctcaatcaccaagaaacttgcattgaggtctgatgatttaattgtaagtggcacatttttggtcttcgtcctactgcccttgttcatggcacatttcctactttaggacgattgtttcccctttcgggatacgtttactatactaagccctttgtcttgatcattccttctcaatacctaatgttcattctccctcatctacctgcctattaaatgtttgaattcctcagaattcatttgctggtcttctcactttgtattcctaaggtggtctgagtccctcttaagatttccactaccattaatatgatgacaatactcaagtaaatatttttaaccctgacctcttttccagggctccaaacattaccaaagtcaaggatctgatctgattttgttcttccacatttaaaaaaaaatcctcagggtctcagtagaaaatgtttttttttcgctcaagtgatctgtagatcaaatacaattccagtgaaatcacaattgagttttttatggaattaggcaattgtttttaatgtttatgtggaagaacaaaagatcaaaaagtaaccaagacaatcctgaaaaaaaaatggaggatactagccctaccaaatataaagacttattaaaaagctctagtctgttattggctcagggataagtaaaatagactaacagaatagactgtggtgctcagaaacagtggaaccgtaaggaaaggatgaactgttgaggaaataccactgggttgtttggttattcatatggagaaactacccaaaagatgaacagccttttccatgtattgttgtgctgtaagtgccatgcacatatttcctatatgtggaaagggttggaaagtactaccttaagaggccatggaagattatatttgtatggtttgtatggttgctttaacaaaagtataagttacataggctggaatacttaggcaagtgatggtcattgtttagtaaaaggtaagagggcaagaaaggaactgaaatttgatgtagatgtgctatattctataaatctgtaaattttgttcttaattgctgtatttctgtcctttaaaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtatgaaatataaaactcttaagctttttcttttttctttcttttttttgggggcagacggaggggcagacagattcttgttctgtcacccaggctggagtgcaatggcgcaatctctgctcactgcaacctgtgcctcccgggttcaggcagttcttgtgcctcagcctcccaagtagctgggacgatagccgtgtgccaccacacctggactcttaaacatttattatttgttaacttcacataagccctctcattttgttttgaggaaacatatccaagaaagctaaatgagttgtacaaggaaagcagtaggagaggtggcagagccagttcctggatctcacacttaacaatctagtgatttgttaaccttttatcaccctaaaagaggaaatgtttagaaatattttggggctgggcatggtggctcacatctataatcccagcactttggcaagctgagatgggtggattgcttaagtacaggagtttgagaccagcctgggcaacaaaatgagattccatctctacaaaaaaaatcaaaaatttagctgggtgtggtggtgcgtgcctgtggtcccagctacgtgggaggctgaggtgggaggatcgcttgagcctaggagatcaaggctgcagtgagccatgtttatgtcactgctctccagcccttgtgaaagagctagacccagtctcaaaaaaaagaatgtatttttgtagtatacagcaaacctaacaaaattttcagtgcttctttgaagctttgtagatatgatttagatttttttttttttttttttttttgagatggagtctcactctgtcacccaggctggagtgcagtggcacaatctctgctcactgtaacctccgcctcccaggctcaagcgattcttctgcctcagcctccggagcagctgggattacaggcacgcaccaccacgcctggctcatttttgtatttttagtagagacagggtttcaccatgttggccaggctgcccttgaactcctgagctcaagtgatctgcgcctcagcctcccaaagtgctgagatgacaggcgtgagcgtgaaccactgtgcccagcctcatttttatataatctttgtgcataatggcgattttgataagagcaaaccacactttaaaaaagtatttttgagaccattgaagaatttgattgtggctcagtgcagtggctcatgtctgtaattccagcactttgggaggctgaggcaggcagatcctttgagccccaggagctggagaccaggctgggcaacatgacaaaactctgtctccacagaagatacaaaacagccagatgtggtggtgtgcacctgtagtcccagcttgcttgggaggctgtggcaggaaagtcgcttgagctcaggaggcagaggttgcagtgagtgtagatcgtaccatttcactcctgcctgtgcaatgggtgtgaaactcagtctcaaaaaaagagaacatttgattgtagacttggtaataggtatgaattatttaatcttttaattttttgtttttgtttgaggccgagtctcactctgtcacctaggctggagtgcagtggcatgatctcggctcactgcaacttccgcctcccaggttcaagtgattctcctgcctcagcctcccgagtagctgggactacaggcgcctgccaccacgcctggctaatttttgtatttttagtagagacggggtttcactatactggccaggctgatctcaaactcctgaccccaggtgatctgcccacctcagcctcccaaagtgctgggattacaggtgtgagccactgctcctggccggtatcaattattttagctgtttcataatcattaattgttatgtaagaagaatgtctgtgtttttccaggaatgcatacttgagtgtgtagaggtaaaatgacatgcctgggatttgctttaaaataatatcagcaaagagaaaaggagagggagaagataaacaaatgtagcaaaatcatgaaaagtattgaattaggctgatgagttaatgggagttaattcaagtcgtctttatctacttttgtgtatatttgaaatttttcattataaaaacatttatacagttcagggtttttggttgtcttttatgtccgccaccactaactagattgtgtactctaaggaagggattacaacttgtttttgaatctctgttgctttatatagttgctgacattgtagcatagtgtatcatgcacatacagtgttgaataaattaataaaagcgtatttaattaagtatatgctgtcccacagtacttccctttctttctggagctttactccccatgacacttactactgctgcctctttctttgatcctaagtgataaaaatgactggctttttattctttgcttattgtatattacatgccacttttatttagcaggatttcttggtggttccattgaaatgaggtcatgttcccacatcctttgattttggcaaagtagttttttgttgttgttgtttgttttttttgtgagacagagtctcacactgtttcccgggctggtgtgcagtggcaccatctcggctcgctgcaacctccacctcccgggttcaagtgattctcctgccttagcctcccgagtagctgggactacaggtgtatgccactagcctggctagtttttgtatttttagtagagacggggtttcactatgttggcctggctggtctcgaactcctgacctcgtgatctgcccgcctcggcctcccaaagtgctgggattataggcacgagccacctcgcccggcctgacaaatagttttttaaatcagtaaaactgtgtttatgattttgataaatatgccttctattaaataacaaggcagaattgctaagtttcctaactaaaatgacccctgataatcagtttttttcagccatagatcttcattcactggtcttttcaaaaataaatgatgatttttaaaaatcaggtttctgaactacgctagtttgcatggtcttttgttttccagaaactgccaaaatccttctattgtgcttattttcaaataattgtctctaaaattctagaaatattccctttaaaaaagaaaatttgaaagaatgaacaagtaagcaaactaaaaaaccaagaactaaaaacatggagtccatgaccagcctgggcaacacagtgaaacacgaaaccctgtctctacaaaaaaatacaaaaaactggctgggcaccgtggctcacgcctgaagtcccagcattttgggaggctgaggcgagtggatcacctgaggtcaggagttcgaggccagcctgaaaaacatggagaaaccccatctctactaaaaatataaaattagctgggcacggtggcacatgcctgtaatcccagctacatgggaggctgaggcaggagaatcgcttgaacctgggaggcagaggttgccgtgagccgagatcgcgccgttgcactccagcctgggcaacaagagcaaaactccatctcgaaaaaaaaaaagaaaagaaatacaaaaaaattagccaggcatggtggcacacacctgtggtctcagctactcaggaggctgaggtgggaagatctcttgagccccaggaagttgtgactgcagtaagccaagattgcaccactacactccagcctaggcagcagagcgagaccctgtctccacacaagcacatacacagagaaacaactaaaaacatgagtgccatttgctatgtggagcaggggtcacagggattagataaggtggctatggtcttaggagaaaaggttcatctaaattgtaccataaggtaatttcagcagaagcatgttcctagtactgaggtaggagttattttaataagtaaatgccttcgtaattgcttttttatattagcaagtggtgtcggataattttgctaattaaaagatacctaaaataaatttaaaagtaatcttgcccaccgtaaataaatataaaatatttacatattattgtgttcctcaaatttgtagactgagagaaaaattgtttaaattactcagaaattgacaactggttctagaaatgttaactcatcaaggccaggcacggtggctcacgcctgtaatcccagcactttgggaggccgaggcgggcagatgacctgaggtcaggagtttgagatcagcctggccaacatgacaaaacctcatctctactaaaaatacaaaaattcatcgggcttgctggtgggtgcgtgtagtcccagctatttgggaggctgaggcaggagaatggcttgatctgggaggcagaggttgtagtgagccgagatcatgccactgcactccagcctgggttgacagagcaatattccatctcaaaaaataaaaaataaaaataaaaatacagtctgttggcagttaatttaaggagcatgatccatgtaaattaaactcaacttagtaatgttttcagtgtgtagccagtagtgttttcagtgtgtagccatgtaataataatacatattttaaaatcaaagcaagaagtaagctcttcgcaaagtcgttcattgtctggttgttgctcatttaattaaggattctgtagttggattataatgccctcatcaaagtaataattgatgtccctctgaaaaacacgtagattaattaaaataaaattaaatttaaaacttaaaaacaaaaaaagtacttagtgtcccagctccctgtagtcatgatgcctattagtatgttttgtttcatggggagccttgcaaatggcatgatttttaagctttcaggagtggtgaatttattattccaattaagctaaattgtttccattatagaaaaggcacaccagttttaatgttctaagcaaagtttaagaataaaaatcacaacttccaaaacaaaacagggtggtttgggggtgaggtggggcacagtctttgccaccttaaccttaattagtatagatggttcagaattacccaccaataaatgttttttcttctgacatttcctttgacaggtggtggaagatggatatgaattttttgctaaacgacagttggtaaccttattttcagccccaaattactgtggcgagtttgataatgctggtggaatgatgagtgtggatgaaactttgatgtgttcatttcaggtatgatgtaaacataaatatataagaactagaaatctaataaaaactattatcagaattcgttttagatttgtgaagtttccttgagcaagtgttgaaagtctgtttaattcagaagtgattaccactcaaactcattagatatttctattttcagtcacaaagtttccagcatttgtggtatatatcaaatatgaccgttttagggaacctaagttacgtcagtcattcttgattcagatgttttaattgttaaaattcctctatgaccttttgaatagtggcttactaaaagaatgtgaatgtaatgaatagtttaggcttttgttttcttttgcaaagtaaatgggtggaacagacactgggaaaagaattacaaactcagatgaaaataaagtaaaatagttccctggctgggcacggtggctcactcctgtaatcccagcacttcgggaggctgaggtgggcggatcatgaggtcaggtgatcaagaccgtcctggctaacactgtgaaaccccatctctactaaaaatacaaaaaaattagccgggcgtggtagcatgcacctatagtcccagctacttgggaggctgaggcaggagaatgtcgtgaacccgggaggcagaggttgcagtgagccgagattgcaccactgcacgctagcctgggcgacagagcgagacttggcccccaaaaaaaaatagtttcctgaggaaaaaaaactttcaaaataatactaaactacccgtttatgtcacaggaacatttatttatttatttttttcttttgaggaagcacattgtataccatgtacggggggttgtttgctcacttttattataatatttttattaatttatgtacgtactaggttcaggggttacatgtgcaggtttgttccatgtgtaaattacatattgctgaggtttggtgtatgaatgatcttatctcccaggtagtgagcatagagtttttcatttcacattccccctcaccctttccactctagtagtccccagtgtctattgttgccatctttatgtccatgtttacccagtgtttagctcctgcttatgagtgagaatatgtggtatttgattttctcttcctgcattaattggcttaggataaaggcctccagctgcatccatgttgctgcaaaggacctgatttccttccttaattttatggtcgcatagtattccatggtgtatatgtaccacattttctttatccagttcactgttgatggacatctaggttgattacatgtctttgctattgtgaatagtgctgtgattaacatacaagtgcttgtctttttttgtacatacccaaagtagtgggattgctgggtcgaatggtggttgttttaagttctttgagaaatctacacactgctttccacggtggctgaactaatttacactcccaccagcaatgtttgaacattcctttttctccacaaccttgctgacatctattatcttttaactttttattaatggccattctgactggtgtgagacagtatcttgtggtttgatttacattaatagtgatgatgagcattttttcatatatttgttggctgcacgtttgttttttgagaagtgtctgttcatgtcctttgcccatttttaatggggttgttttttgattgttgaattaaatgccttatagagtctggatattagacctttgttggatgcatagtttgtattttctctcattctataggttgtctgtttattctgttgatagtttattttgctgtgcagaagctctttagtttattttggtcccacttgtcaatcattgttttggttgcagttgcttttggggacttggtcataaattatttcccaaggacagtgtccagaatggtatttcctaggttttcttctagggtttttatagtgtgaggtcttatatttaaatctttaatccatcttgagttaatttttgtgtatggtgaaaggggtccagtttcagtcttctgcatatggctagccagttatcttagcaccatttatcaaataggcagtctcttctccattgcttgttattgttgactttgttcaagatcagatggttgcaggagtacagctttatttctggctcctccatcctgttccattggtttatatgtctgttttggtaccagtaccatgctgttttggttactgtaagccttataatgtaccttgaagtttggtagtgtgacgcttctggctttgttctttttgcttaggatgctttggctattcgggctctttttcaatttcatatgaattttagaaaagttcttttctaatgctgtgaaaaatgacattggtagtttgataagaagagcattgaatctgtaaactactttgggcagtatggagattttaacaatattgattcttctatccatgagcatggaatgtttttccatttgtttgcatcacctctgatttctttcagcagtgctttgtagttgtagagatctttcacctccctggttagctgtattccttgatattctttttgtggctattgtaaatgcagttcttgatttggctctcagcttggatgtttttgatgtatagaaatgctactggtttttatacattgattttgtatcctgaaactgattaacaaagttgttcatcagttccaggcacgttttggcggagtctatggggttttctgtgtatagaatcattatcgtcagtaaagattgtttatcttcctctcttcttatttggatgccttttatttctttatcttgcctgattactctggcagggactttcagtactctgttgaataggggtggtgagaatggtcatcctagtctcttgttccagttctcaaggggaatgcttccagcatttcccttttcagtacgatgttggctgtgggtttgtcagatggctcttactattttgaggtatgttcctaatttttcagtgcctaatttgttgagggtttttaacatgaaagggtgttgaattgtattgaaagcctttctgcatctattgagatgatcatatggtgtttgtttttaattttatgaggtgaatcacatttattgatttgcatatgttgaaaccttgcaccccaggaataaacccttcttgattgtggtgagttaactttttgatgtgttgctggattcggttttagtattttgttgacgattttgcatctgtgttcatcagggatattggcctgaggttttcttttttccttgtgcctctgctaggttttggtattacaatgatgctcacttcgtagactgagttaggggggaggtcctcttcctggattgtttggaatagtttcagtaggattggtactagctctttgtacatctgatataattcagctgtgaatctttctgggccagggctttttttggtttataggtttttttattactgattcagttttggaacttgttattgttctgttcaggattttaatttcctcctggttcagtcttcggagtttgtgtgtgtttctatgaatttattcatttcttaggaggtcatgtgtgtttctatgaattcatttcttgggagcgcatgtgtgtttttgtgaatgtattcatttattctaggtttcctagtttgtgtgcacaggtgtttataatctctaggtattttgtatgtctgtggggttggttgtaatgtcacctttctcatttcagattgtgcttatttggatcttttcttaatctagctagcagtctatcttgtttattcttttgaagaaccaacttttggtttcaacatttacatttttaaaagaggccagttttagctttagtgtgctcctacaaatcattcttgttcactgagtaaaacagcttcagtactttgcttttgcaaaggctattctatgtctttgatgtacacacactgtatttctcttaaaatgcattggggctttcccattcctctttctctttatcataatatactgtttccatcaattagtacaattgaatggtaaatggttgattgctcatttacaaattaaatatagtaaccataccttatccttccagcagttgtcatagtggtgttggattaatatattctcttcactaaggcactattatgttctaaatagtttttaaaaaatactttgtacatatttctatactgttttagttttggaaaatcatgacttttttatgtataatgtaggttaaagctctatttacatccaccagaatgagtgtagtaaaaaagccagactgtatcaagttttggcaaggatttggaggcattagaatcttcatacattaatggtgggaatagagttctcatatgatgcagcagttttacctctaggtatatacccaagatatatgaaaacatgttcacacaaaaactgttacataaatgtgcattattccttatagccgaaaaagtcacacaattcagatgtccatcagctactgaatagataaactgtggtacatccatacaatggactgtacaatgtacaactcagcaataaaaaggaatgaaggactgatacttcaaaactggttttgaaaacctgagtgaaagaagccagtcacaaaagaccacatattatatgatgccagttatatgaaatgttcagaataggcaattctatagagacacatagtagattagtagttggttagagttagaggatgtggagagcaggaatggggagtgactgctgatgggaacaagctttctttttggggtgacaaatgttctaaaattagatttatatcaataaagctgttttttaagtaaaaagatctatttatacataaataaataaggtctgaagggtttgtgacttgtaggttagttaccctcctaagttactgtatcagaattatgatgacaacatagatcttctgactcttaaaccagtgttcttttcctcacaacagagatacactaagttcaaaaagttttttacttaaatctaaggattggatagttgatagagttagtgtacttttgttattaaaatatgagtggaatgacaaagttcagacatttgcacactttaagaaatgtttatggaactttgctattctacatttttattgcatttttgcagtttatgccatttattgaaaatcacaattgtaacaattttcttaacttctgtacatgaaaaaataacattatttgttaataatttactttaagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatataagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatgaccataaatctttgcttctttcctcttagggatctttgctagtttatgtgattatgaaatcttacttacaacaccacattgtttggggtatacagggtggaagatagcaagtgaacagggggtgcgggtggggagggtttgtgtgtgtgtgtgtgtgtgtgtgtgtgtgtaagagagaacaaactaacggcctgaggctaataggttcagcattcctttcagatactatatgcaaaaaggtgggaacctaaggtctgttcctggaggcttttcagtgaagcctggcataggatcggcaagttaaaatatgtattaatttttacagctgcctaatcagaatgattcagcagatttacaggccaaatttttcctacaaaaccagtgacatcacagctaaacatctagaactttcatagattattgtacaaatttattaaaaggcacagtaatttatggtctatcatgtaaacactgattctcgacaaaaccacaaaggcaagtaatacagtgcaacagaaaaaagtagtccagaggagtttctttttttctttttttcttttttttttttttgagagagagtcttgctcttgtctcccaggctggagtgcaatggcatgatcttggctcactgcaacctccacctcccaggttcaagcgattctccagcctcagcctcctgagtagttgggattacaggagcctgccaccacacccagctaatttttgtatttttagtagagacggggtttcaccatgttggccaggctggtctctaattcctgacctcatgatctgcctgcctcggcctcccaaagtgctgggattacaggcgtgagccacctctcccggccaagagtgttttcttaatgtaacaagtttaatctgaagtaagtcttaaatctcctagtatattttttggaaaaaaaaaaagccaaagaaacaaaaccagagtgttgaaatgctacctccaatatatgtataactcaaactgataattggcatggtttctgacagtgctgctgtttaccagcaggttattgacagactgacacctgttccattcttgaataaatataaactttgtctctctagctcttagtttaataaaaatccctgagaaggaggatgtgcagggtggagttgctggagaaaacttaatgtcttgtagaactcataactactcaatttaccaacttaaaaattaagctacatattaggaaatgtagtttatcacatgtaataaggaattgagattatcaggaaatcttgggtgaggctcaggatccaacatataactgggcccagcacataaaactgttacctgacttcaataagaaattttagccgggcgcagcggctcatgcctgtaatcccagcactttgggaggctgaggcaggcagatcatgatgtcaggagatcgagaccatcctggcgaacatggtgaaaccctgtctctactaaaaacataaaaaattagctgggcgtggtggcgggcgcctgtagtcccagctacttgggaggctgaggcaggagaatggcgtgaatccgggaggtggagcttgcagtgagctgagatcacgccactgcactccagcctgggcgacagagcgagactccatctcaaaaaaaaaaaaaaaaaaattttagaaacacagatctctgcctcccagtgtaattgcctcagattttgtagcacatctcttaactgcagcttgataattccactgaaattaattctattggtcatattaaagaacaggttaaaaagtctttattgctgtactgtaaagcctgttttgagtggaagaccctaatcttcttttagtgaattccccaaactctgggtatgctcactgacaacacaagttgtaatcccttttttttttttttttttgagacagggtctcactctctcgcccaggctggagtgcagtagcctgatcacagctcactgaagcctcagcctcccaggctcaagtgatcctgccgccttggcctcccaaagtgctgggagaattataggcatgagccatcatgcccagcccattttatttttaatatatcatcaattatttcttatacagatccattaggatgttgaatgctcctttaaaactttgttgtatttgtcggccaggcgcggtggctcatgcctgtaatcccagcactttgggaggccgaggcgggccgatcacgaggttaagagatcgaaaccatcctggccaacatggtgaaaccccgtctctactaaaaaaaaaatacaaaaattagctagatgtggtgcgcacctgtagtcccagctcctcgggaggctggggcaggagaatcacttgaacctgggaggtggagattgcagtgatccaagatggcaccattgcactccagcctgggcaacaagggaaactccgtctcaaaaaaaaaaaaaaaactttgttacatttgtctttaaaagtcataaggcctagatcagtcttgtatgtgactagaatgtagctctatgggcagggttttttgtttttttttttttgagacagggtcttgctatggtgcccaggctggagcacagtggcacaatctcagctcactgcaacctcctgggctcaagccatccttccaccttagcctgcgtagtaggtgggactacaggcatgtgccaccatacctgctaatttttgtagagtggggggttttaccatgttccctaggatggtctccaactcctgagctcaagtgatccgcccacctcagcctcgcaaagtgttgggattacaggcatgagccattgcgcccatgcaggtattttttttctcttttgttcactgattcgtatctccttatcgtagagtggcgcctgccacataggaggcctgcagatacttgcttaatgaatggcaagtgggtgtcaaaaatctctacttgtattactgttttgacaccttgacctgaagaagttaaccacaaataataaaattccagtttttctttatcctcatgtaactgcttttgtctcttatgacaagaatgctgaagtttcaaggagaaaattgatttgagtctgtactgccaaaataaatggtttgtcaaaactctggcccctactttgtaaactattggtaagtttaagaagtcagccaggcacggtggctcacgcctgtaatcccagcagtttgggaggccaaggctggcaggtcacttgagatcaggagttcgagaccagcctggccaacatgggaaaaccctgtctctactaaaagtacaaaaattagccaggcctggtggcacacacctgtaatcccagctactcgggaggctgagtttcttgaaggagcattttgcagctagcacctgacaggcatagtggagaagttgcctgttactgagaacaaacatcgcaagatcctcaggattactttctttcctcccctttctatagtctctattctgttttcttgatcttaatgtcacctttgtagtgagccacctcacatattttaggaaagttgtataatttgtgtaatattttgtctttcagaattcatccagtaagtatgagcacttaaaactaggaatcgaacttggagaggctgttgcctcatctagcacaagtatgtcataggcagtatggagaaagatcaactatcttttcagtaaggaacaaaaaagtctgatacagtggagaaaactattctagacagaaatttaatacagttatgttgttagaatgattgttctatttcttttgttgttgcttttgttttgttttctgagacggggtcttgctctgtcatccaggctggagtgcagtggcgccatcttggctcactgcagcctccacctcctgggtccaagcaggtctcccacctcagcctctcgagtagctgggataacaggagcgtgccactgcgcccggctaatttttgcatttttagtagagacggggtttcacctgatctcaggtgatccacccacttcggcctcccaaagtgtgctgagattacaggcatgagccaccgtgcccggccaattgttctatttttgatacttctcagagcttttaatctctttaacttaaaagaacagtcacccaggctgaatacgtggtctcagtgcagaattacacgaaagaaatttggcccaatttgtctcaaagacccttacaactccatcaagtaagagagggaagggatattgcatgaacatagcaactatccctgctttcaagtggtttagcaggttaggtagaaccatttactagaaaagggtgctgaaaagaaaatccagagctgtcttctgtgttaagtcggctgggcacggtggctcatgcctgtaataccagcacttagggaggccgaggcgggcggatcacaaggtcaggagatggagaccatcctgactaacacggtgaaacctcgtttctactaaaaatacaaaaaattagccgggtgtggtggcgggcacctgtagtcccagctactcgggaggctgaggtagaatggcgtgaacccgggaggcggggcttgcagtgagccgatatcgcgccactgcactcctgcctgggtgacagaacgagactccgtctcaaaaaaaaaaaaaaaaaaaaatcatctagtcacagaaaacctgaaaataagttgacaagatgtaaactaatgggaactcttaaaattggtaacactgcttggaaaatgaatttagcatttataaccttttaaaactgaacatgtgcatgccctacaacccatcaatttcactttaaagcatttatggaaaaagtgcaccatggtgcattaacaagcaaagtagtcaaaatacttgattttaagtcgtagacattcaccaatcagaccaccagttaatcggaacttgaaccagctgtaaacaatatggccttgcagaggcgttccccatggcattcacagtagcaaaaggatccaaatgcccaaaaaaatgacccaaatgcccattgacaggagcattggtatattatggtatatttctagaacagaaagcaacaatgaaaatgattcacagtgttatgcattagcatggctaaatctatgaggaatactgaggttgaatagttcacaaataaaacttgtgttttaggatacgcaaagaaaagagaatgggaaacagtcgcctcctggggatcataatgggagaaggaggagcatacagaatctcaacagtattgttgatgtcctgtctcttggatgttaggttcatgtgttttggtaggcggtggcttcacaagtttttattatgtctcagcctccatatatgctacatgtattgttttgtacatttttaaagtatgtatatgatccgattcatatataattgtatctgtatacacaaacatttttattttaaaaagctggttaataagattacataaatgataatttcagaaaatgctacaggaattcaagcatggcacacagcctgcacttactaagcactcaaatgatgatgagctgattaatttaagctgggtctcaaaggctggataccagacagaaattttaaatgagagtgatgaagagagcacactacagtaatatgcaaggtcaaagaagtgggaaagttcaaaacaagtatgagtgtttctctcattcttactggataataggagatacatttaggaaaggagagttaggaaattagaatggggacaacctggaggcactgcaggacacagtgcaggagatgatcaagttatggacaatcaatgcttttttagtggggaaaagccatgcctagagacaaaggaataaattgttcagttaagtgttttgagttctcatccaatcccaggtcaaatgaaaagaggcaagaaggaagctaacaacacctactgtggaccagtgcactgctagtttgctcgctatcaaattcgccccagacgcttttacagagtaggtggtatcaccctacttttacatttaatgagaggtgccagggttaaatgatttgaccacgttcatacagctagtaaaatggtagtacctgaattcaaaccaagtgtatatgattctaaagtatattcacttttctccacacaccaacatagtttaaaaaacaaaacaaactcaggaatgagaacactcaagaaggcttagttggtagtaaccctttacttgaagtcaaaacttaagcaataagctgcttccctgatagcttaatgaatatttatgtgtatttgctggcttttatatgcaaattttacatgtttcctttgtaaagattttgggatcctaaagaaccttctcataactgtactttgtgcgttatacagccacttgcatttccttcatggcacaactcactgtgccttgtattttagttgtgtccatatctgtctagcttggaagctctagaaaggtaaggccatgttgtcttcatcattgtggtacttgccatgcctctgtgtttttcatgtagcggacattaattgttcagtaaatattttatactcgaggctggaaattaatcatcacaacaccggtaccttgcaaaaacaaggggaagagcagagagaagtcaggaaggatccttagggaaaagctagaggaatgaagcttgaagcagccattttcctcaagattttcacaaccagttgatgcttcttggcccattctcccatttataggccagggagaaagagtcaagggcatgtgtaaggaaaaataagttcccagttggccccctcctcgtacttgtaggtgaatttgtcattattgtgctgtgtgtggaagcacaagaaggaaggaattaactcgttcttcagaactgctgattgaggagctatttgctggaagtaccacaagtaggcagagccaggttgccttttaagagtaatcattgtattagccaaaaaatctggaagcaatccaaatattgaaatgacttaaatggtccatccactctggaatattatgcagtcattgaaaacgtttcgaaagactagcaacatgaaaaaagccgtgatatggagaccaaaaaaaaaaaaaaaagatttacactgggtgtggtggcttaggattgtaatcccagtgggaggattgcctgagttcagttcaaggccagcctgggccacataggactctgctctacaaggcatgtttaaaaattaggcgggcgtggcggcacctgtggtcccagctacttaggaggctgaggcgggagaactgcttgaacccgggaggcagaggtatgcagtgagccgagatcgtgccactgctccagcctgggcgacagagcgggactcagtctcaaaaagaaagaaaaagccggttataccttaggagggacataaggaaaggatgggatcaaaaagctgtttagaattctttttatttgttcattcaacatgcatgtattaagcacccacgtagtcaaaggctaggacaaagccaaaaagattactgctgcagattcacagttacaatagaatggccccttctcacaagaagccaccgtattcacacgttgtgcttttctcagttcaagcggcctcttccttttgagtaaccagggtaaccacgctgtgcccgcgtgtgccgggcggggaggggaggccgcagccccagccccgggggcctggttgtctaatcgaagggaagtaaacggccccaacgcaagcctgactgcgagacgtgcccaagggaggtaggtcgaatgaagagggttgtgtgagttttgcgcgggcaggcgggataacggaggagggaggcccgcggccgaggctcgggcgggcggggggcagggaggggcggggttcgccggcgcgcactcccaggcaggccccgccccctcggccggctgtgcgcgctgattggcccctgccggcctcgcgctccctcgctccgggttggcgggagaccttagagcgggtaccgctgctggctagcgaccgacgagcaaccgtctgaggccaggagcgctgcgacggagccttgaccgccgttgcccggccctctcccgcgcagccccgggcttccgcaggtacctgtgctcgcccccgggaaggggcctcgcaggcgaatctccagtttcgagtgtgcccggtccctgggttcgctcgccggcgaccccaccgcccgccttagatgagaaggcagcgctccagcctcgtcctcacgccgcctcccgtgggcgccctcagctgccttcgcggcgacgacacacgcgctccccgcagcgggctctgggctgagggacctggcgagggaggcagtggccgcgcaggttggggctttggccgccctccgcccggcggcgtagcgggtgaaggttccaggggaaggacgggcagggccgataccggaggctgctcccgaagctcggccgtctgctcggagggagggccctgggcaggcgctcccgtctccacgtgtgcctgccgcctttattgtgggaggaatggagatttggggggtctttttgataaatcctacctccttatgtcccattaaacacctctttttgtccccaagatcgtctgccccagaattttgagatctgagctgctgtgtctcagtaccaggcccgtagctcatttctcagaattcacgaagattctcttacatgacatccagtaggactggagggcccctagcctcaatcttttaaaaagccttatgccgagttgggcgaatccttgaggccaggattcgagagcagcccacagcgaaaaccccgtctctacaaaaaaataatgaaaaaaaaaattaaccgggcatggtggtgcgcacttgtaatcccagctacttgggaggctgaggcgggagaatcgcttgaaccctggaagcggaggttgcagtgagctaaaacccgtctctacaaaaaataacttaaaaaaaaagtatcctggcatggtggcgggcgcctgtaatcccagctcctcgggaggctgaggcgggagaatcgcttgaacccgggaggcagaggtggcagtgatccgagatcgccttatagctggggttagctggttttgttttcttggcaaggtgacgataagtaatactggagtgcttactatgtgtcaagtgttttacacatgattttatttaatatttaaaactgatttactggttaaagaatatgggactttgatgtcagttctgcattcaaattctagctttatcacttactatgagcctttgggaaatttcttaacttctttaagcctcaaatttcttatctagaaaataaggataaaataatacctaccacacagagatgttttgagaattaaatgagataatgcatgtaacacattcatcagtgtctggcacatattctctgtgtgtgactgcattcataaggaagttaaggcttacttgcctgtcctgactgagttgccaatggatattgctattaggtttttcatataggcaaatgaatccccagacaacttctgcttgtttcatattatggctgggaaccaccaccctttatatcaccccccagagaagaggttatttcagatgcctctagaatttttgtgatttacttaccaaaaaaaaaagaaagaaagaaagaaagaaaatcccaaacatcctattcaagtatgaatcctggtatgatttttttaatgttcatggagtccatataaaaattcactgaaggaggccgagcatggtgtctcacgcctgtaatcccagcgctttgggaggccgaggcgggccgatcacctcaggtcaggagttggagaccagcctggccaacatggcgaaaccccatctctactgaaaatacgaaaattagcggggcgtggtggcaggctcctgtaatcccaactactcaggaggctgaggctggagaatcgcttgaacccaggaggcggaggttgcagtgagccgagatcgagccattgcactccagcctgggcgacaagagcgaaactccgtctcaaaaaaaaaaaaaaaaaaaaaattaaaggattttacctgatgagcacagtttctcctacttctccttctttccctatctcttgcagttcctaaaatggctcatatttttaatttggttttcgttcctttcctcttgcttgctctataagaactctcattctcttagtatatctaagtgaagagcaaaattaaaagatacccttaggtagaaattgaccaagactagcattgatagcttctctccttcagcttgttgtatgtaccttttctgccagtgtttgcttattaaagacaatgaagctccacttggggaatttcagacattttcttctcattcagttttctgaaattgtatgggaaatatcccaacacatacataagggtttagaggaatagtgtaaagacgcctactgtggatatattttacctttttgattgatagaaaatttgcattatattttatgatatatccatggttgttttaatataaaagcactattttaggttacttagcattgagtaaaacttatcttctggaatatgtgccacagttattttgtgttctggtacattccacccaagtctagccccaacactcaaatttgaagcagaattcttagccacggtactataccactgataactccatactagaatttgagaatcctgagtactctttagtttcttctatctagattttttttttttttttgagacggagtcttgctctgttgcccaggctggagtgcagtggcatgatctcggctcactgcaacctccgcctcccgggttcaagcaattctcctgtctcagcctccccagtagctgggactacaggcgcctgccaccatgcccagctaatttttgtatttttagtagagacggggtttcaccatgtcggtcaggctggtctcaaactcctgacctcaggtgatccgcccacctcagcctcccaaagtgctgggattacaggcatgagccactgcgcccggctcttctatctagatttaaggctgctcttactttgaaaaaaatatgcagatgaggcctccagctgtctcccagatgaggtgggcaggaaagagcagaacgttcttactcaagtctcaaggctcaatttatcacctactcctctttctatggagtttataacccgcaccccaagtacataattgccttcaatttggcaggactttaggatctaggaagaaagatgggatgagaggagcaattagataagtatattcctctgcctagttcttcaaaatgtagccctgtgctatctaatatggtagccactggccacttgtgtctattaaacacttgaaactgaataatttaatttttactttaaaaactgaaggagcatatttttctcctacaaattacttcatttttaaaaataggactgcatttcacttttactgttgaaaaattagtatcagaacagatttgtatataagcatattcatctaaagtaacaaaaaaaagaaaaaaagattgagatatgctgtaagaggaaaatacgcagcagatttcaaagacttagaatgtgaactatctcactgatttttatattgattacatgttaaaatggccttttggacatattgggttacataaactttattattaaaagtaattttatctgttttgttttgtaaggtggctctaaaaatacaaaattacatatgtggcttacattatattggacagtgctgttctaacctcgctaaatccaatcttattttccagtccttccttcagaagggaaatttctgagggtcaggaaggggaatctgtacctcactccttgaacaccaaggaaggtatggctgcctgagtcactgtgaggttgcattcagaggttctcagtagggtcctagagtagtttcctgtgttgcctattcatacctcaatttcccattatcctagaaatatttgaccacaaaaataatactaagtgtagtaattatgtgaactaatcaccaccaaagaaggtgatgattatgtatattgttaaatattgatagattaactgtctcagattttattagattatgacaacatacattcatatacacttataatcagtcactcaaatagctttgtcatacacttacaactttaaaaattagaacaggccaggcatgatggctcaagcccataattcccacactttgggaagctgaggcgagaggatggcttaagctcagcagtttgagagcagcctgggcaacatagtgagacctcatctctacaaaaatttaaaaaataagccagatgtggtggcatacacctgtggtcccaactacaagggaagctaaggaaggaggatcacttgagtccaggaggtcgaggctgcagtgagccgtaatcatgccaacgtactccagtctgggtgacagagcaagaccctgtctgaaacacacacacacacacacacacacacacacacacacacacacacgagaaaaaaaggaaaacagaaaagtaagtaaaataaaaattagaccaatttatgaaaagccttcaaagcacatctacattttttgctagaattgctttcaacttttcaataaataccaataaatgcttattgaataagtgaattttataatatatcaaggaatttaccaataaagagatatggggttttgtgggagggggggtgctttgtaatttaatacttgataatacattctggaaatagttgtccttgtttataaaaaatttgaggtggcatataacaacaatataataaaattatgtcaattcaagcagaatagaaaaaattagaaaattagccggaaaaaagaagactacaaataaattatgaagtcagcatcatttctataattaactttcaaatttggtcgagttctgcagccaaagcaaaatggcatacagtatcttcttatttgggaagaggatgtccgtttgttacccaaaagaagcatagcttttcctagcgctgaatttcaaaagcaatttttaatgggagtcactgtcacaaataacattttaatggcaagtttagtaacattttatatgactgcatatggtagtatcatccagttagttgtttatatatgaaatgaatgtgtgtgatgaataattgtatgttttatttttacaggaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttggtaggtttaaaatattgtaatagtggtaattataaagtactaaaaacctagaatgtaaacatctaaatgtttttattctgatcaaagaggatatcattatttttgtattaaatttcccatctccaaccaaatttgtttttgttttacttagtctttttttttcaatgttgggtttttgtttgttttgtttccttatggattaaaaattcatactcatctagcttctagactacttaaatccagatgtcaaatgtaaattctgggcaattcaacttcatagcccatggcatgagttttatttgacctaaaataaaatactacataaagactcaggtgagctaactgacccagtttgactgggcctaaggggtttcccaggactttctctgctaaacccaagaaaactaggaagcttggtcacactagagaagtttcaggataacagtttgggaacattgttaaaaattaactatgctttatcatgtccatataatgaaactgagtttgaatttgtttaggttatgagacagtgctactttgctgataatttcttaacattggcaaaaagaaacttctttatagtactgtactcctaactaggaaagagagggaattttttttttttgaggtagggtaataaggtaaacagattagaaaaaggggtaggatagatgagttctgaaaaatatttggagtaatgaatcaagtcaagtagatgctacagtctggtagattgtagcttgcttgtttctagaggaaggtcaggcgcattaaagcaagctagttacgatttaaagaaaagcaaaatgaaaagatgaaacaggaaaaaatgtaaggaatataagtagaaaaagatataaagatgcttccccatcagatttagaatgttaataaaagttccccttcttttcattaagagcagaacaaaattattacctgcaaacttttttagtacccaaaactcatcatcagaaacacgggaaaatacctggctgtaccattttaggtaacttaagaaattataaatagagcctgggcgcggtggctcacgcctgtaatcccagcactttgagaggccaaggcaggcagatcagctgaggtcaggagttcaagaccagcctgaccaacatggagaaaccctgtctctactaaaaatataaaattagccgggtgtggtggcacatgcctgtaatcccagctacttgggaggctgaggcaggagaatcgcttcaacccgggaggtggaggttgcggtgagccgagatcgcaccattgcactccagcctgggcaacaagagtgaaactgtctcaaaaaaaaagaaagaactataaatagaattaatgggccaggcgcagtggctcattcctgtaatcccagcactttaggaggctgaagggggcggaccacttgaggccaggagttcgagaccagcctggccaacatggtgaaaccccatcaggcgtggtggtgcatgcctgtaatcccagctacttgggaggcggaggcaggagaatcgcttgaacctgggaggtggaggctacagttgagccgagatcatgccactgcactccagcctgggtgacagagcaagactctgtctcaaaaaaaaaaaaaaaaaaaaaaaaaaaggctggatatggtggctcatgcctgtaatcctagcactttgggaggccaaggcaagtggatcgcttgagctcaagagttcaagaccagcctggggcaacgtggtgaaaccccctctctacaatacaaaaaaaaaaaaatttatctgggcatggtggtgcatacctgtagtcccagctatctggggggctgaggtgggaggatctcaaacccaggaggttgaggctacagttgagccaagatcacgccactgcactccagcctgggtgacaaagtgagaccctgtttaaaaaaaggaaaaaaagttagcaaggcagaaattcttattctcaggaaatcagtagttattcttggaactttccgtatgactacattgatgatattttagtgtacacaaatgaatataaagaagttatgcctttttacttaaaatgaagaagaggagcctggcgtggtggcatatgcacctgtagttccaggtactcaggagtctgaagccagaggatcacttgagcccagaagttcaaggcccacctgggcaacatagtgaggccctgtctctttaaaaaaaaaaaaaaaaaaaaagagaaagagagaaagggggaatggaaaaacagatttttctagattacattctgacaactattaatgtattttgagattatatattttagccctttagaattgaaatattttacctactttctagatgttattatttttaacaatgtgtttgtttgttgatctttttatcctaatagttttttcaaaatgttaattataaataatgaattatgaatcctttttatatagacattttcatatgtatttgagtaatagaaagtggaatagagataaataggagagaagaatgcaaaactaaaaatactgttggatattcagtaaaccaaacacttctaccattctccaatctgagccatatgttaaggcaaatcagatggcttgatgaaggataaagcagtagtttttcgtacagtctttgcaatggtaaatacaccaaagaactgaaaactccaccttaggcaacactggttcattcatttttgttttatttctaagcaccatgtataatctcttgacatagaaattaattcttcaaaaggaaacattctgtttttaaaagacaagttatagctatcttttgttgtagatgacgatttaattcaagatttcttgtggatggactgctgctgtaaaattgcagacaaggtaaatttggtaacagtataacaattaaccagcattataatgtaactgaaccattagagctttaatgagaccttataagaattttctatcttattagttatgattaagaaaagagctagtggccaggtgcagtggctcacacctgtaatcccaaaactttgggaggctgaggtgggtggatcacttgaagccaggagttggagaccagcctgggcaacatagtgagacccccatctctaaaaaatttaaaaattagccaagtgtggtggcatgcacctgtagttccagccacccagctgaggtgggaggatcacttgaacccagaagttggaggatacagtgagctttgatcaattgtgccactgcattccagcttggacaatagagcaagactctgtctctaaacaaattaattaaatttaaaaattaaaaaaataagagctagcctgcactgctccttcaaagcagaagctttacacatgaatttctggaattagcatatagcatagattcagtctatacttaaggaattgtagaatattattgattacatttaaatgaccttaaatttgtatttgattgaaaacagaaatcaaaacaggtgtggcagctcatgcctgtaatcccaacactgtggaaggccaaggcgagaggatcacttaagcccaggagttccaagaccagccttggcaacatagggagacctggtctcttaaaaaaaaaaaaaaaaaaaaaaaaaaaaaatatatatatatatatatatatatatatatatatatatatatatatatatatattttatcctgaggcaggaggattgcttgagccagggagatcaaggctgcagtgagctgtggtaccaccactgcactccagcctgggtgacagagccagaccctgtctcaaaaacgaacaaaaaccaaagaaccacaaacagaaaatcagtatagacttaatacattttgatcagttattaccttttatcaggctgtggagaaaaaatattctgagatttactttactaaggtagtctgcattttagtattttgtaagtcagagaaaacaaatctcagtaatttgtagggtaaaattagtttaacatgttgtttaggaatcagtgtttcataaaagaatgtctgacttacacactgggagcagcgatgtttctatattctttagattttgttgaatggttaaaatttcagctttgtcgctcatacctgtgatcctagcgcttgggatgctgaggcgggcagatcacctgaagtcaggagttcaagaccagcctggccaacatggagaaaccctgtctctactaaaaatacaaaaattagccaggtgtggtggtgcgcacccatagtcccagctactcgggaggctgagacaggagaattgcttgatcccagaaggcagaggttgcagtgagccgagaccgagccactgcactccagcctgggcgacagatcgagactctgtctcaaaaaaataataataataaaataaaatttcagctttgtatttttcaatttttttcttttagaaaaatatttctcgtgctaagaattttcagctttgtaaatgccattttgtaccaagcagtcatatttgaaaattaagcgtgactttacatcactactagccaacagtaaagggaatgagtggaaggttagcttgtgattaaatacaaagtactggggtgaagatttttatttaagcttaagatgacagggatacactagaagaaggtttataaaattttttaaatttcattttggaaaatttaaaacatacacaatttgaagtaaatagaatagaacaaagagcctccatatgcatctcatctagctacaatagatcaactgtggctgttcttgtttcttctaatgcctctcaccaaaaacgattattttgaagctgatcccagacatcctaacattttatccataaatatttcacaatatatcactaaaagttaagagctgttttaaaacaattacaatgtcatagaacttttaaaattaacagtaatgctgtaatatcaaatatacaattcatgtggagttatgatgtgattttttttttttctttttcttttttttttttttttttttgagatggagtctcactctgtcatccaggctggagtgcagtggcgtgatctcagctcactgcaacctccgcctcccgggttcaagcaattctcctgcctcagcctcccaaatgtctgggattacaggcatgtgccaccacgcccggctaatttttctgtatttttagtagagatgggggttttaccatattggccagcctggtcttgaactcctgaccttgtgatccacccgcctcgacctcccaaagtgctgggattacaggtgtgagccactgcgcccgtcaggaagttttaaactttatggttttaaggtgcagtaaagttgttgtgcagaagggggcagtgttggaaaagtaactacctggagtactgtcttaacacgatctcaagagtactttactggaagttactgtgaaaacttggtatcacctttgtggcaaatcctgttacaataggatgaataaatgtcttacgagagataatctgatacattattataacttgtttttaatttgaacagacagaacctggcatatgtgctaataatcaggctagagatgtatctttctaataatacatttaaaacacattctccccatgaaaatacagccatgttattctaatttctgaagtcatttggaaatcattttaaaaagttattttaaaaagtgagtatggatgtctgtaactaaaagggtttagaaaaattatatatacacatacatacacacaaatagagatagcaaacatggcaaatttggtgcatctaagtgaggatgcatggctgttcattttgctgttatttcagtttctgtataggtttgaaatttaaattagataaaagtgggattttagctcaaactattggcaataataaaatttaggagtccattctagtttataatgatataataaatagtcaagaattacttttcactgttcacatggtggattacaggaatccaaaaattaagtacacaattctataataagtaacactttattgttttagcttattcatcagaaaattttaaagttaactattttaaagcagttttatttatgaaagcaaaacattaatattaatttttaacttttttccttatagtatcttttggctatgacctttgtttatttcaagagggctaaatttactataagtgagcataccaggataaatttctttattgctctgtaagtatactttctactaagtgattgttgtgttatctattatatacattacaccttatttaaaacagaggctatttaaaaccttatgtatatctttgaataggccttcctgtataaatgctgtatgttttttactttaataggatatttttatgtttttttcacttatcatgctatatgcctaagatttccttttttatttatttatttatttttgagaaggaatctcgctgtgttgccaggctggagtgcagtggcacaatcctgactcactgcaacctctgactccctggttcaagtgattatcctgcctcagcctcccaagtagctgagattacagccacgtgccaccacgctcagctaatttttgtatttttagtagagacggggtttcaccatgttggccaggatggtcttgatctcctgacctcgtgatctgcccgcctcggccttccaaggtgctgggattacaggtgtgagccactgcgcctggccaagatttcttggagtattcctcttcaatttgtattgcatgttttacatttttcagaatgcttccatataaattatcccaaattctcctctttgtgacttagatattttttaaaaccagaatattctctgaaattttcaattaatatatagtaaaaatcaccatcatcattgcccttttacattgaacaacttgtggaaaatgctctaaacatagtctttgtggacctatatctataacatagtcattattcgtatttgataccattggtattcactggctcttttactaaacacactgagctgtgacaaaggaatacagttgttttccagttcttccactgactttagtttatattcattgtgatctgtgaaatggttttccaatctataggtcagaatacatttggaatttgcattatttaagaatatgtttctggccaggcacggtggctcacgcctgtaatcccaacactttgggaggccgaggcgggtggatcatctgaggtcaggagttcgataccagcctggccaacatggttgaaagcctgtctctactaaaaatacacaagttagctgggcgtggtggtgggcacctataatcccagctactcggtaggctgaggcaggagaatcgcttgaacccgggaggtggaggttgcagtgagccgaaatcacaccactgcactccagcctgggagacagagcaagactccgtctcaggaaagaaaaaaaaaaaaagagtatatttccttttctaccctatagctggatataatgctgtagttgggaatgcatgaatatatatatatatatatatatatatatatatatatatatataaaatttttttttttttttgagatggagtctcactctgtcacccaggctggagtgcagtggcgtgatcttggctcactgcaacctctgcctcccgggttcaagcaattctcctgcctcagcttcccaagtagctgggattacaggctcccaccaccacgcccaactaattttttgtgtttttagtagagatgaggttttaccacgttggccaggctggtctcgaactcctgacctcaagtgatccgcctgcctcagcctcccaaagtgctaggattacaggcgtgagccaccgcgcccagccatatgaatataattttaagtgtttacctagagaacacatataaaaaatatttaagttgaataccacaatagctgtcagcactgaaggtaaagtttttactcaaagtgtatttaattcagaatcaaagagttattaaagaaataggactaggctgggtacagtggcttacgcctgtaatcccagcactttgggaggctggggcggaaggattgcttcaggctggaagtccaagaccagcctggacaacatagtaagtctctacacaaataaaaataaaaaaattagccaggcatggtggcatgtgcctgtagtgccagctacttgggaggctgagatgaagaggatcacttgagcccaggagttcaaggctgcagtgagctatgatcaccactatactccagcctgggcaacagagcaagatgctgtcaggagaaaaaaaaaaaaacaaaaaaaaaaaacaggactagaagaaactgatttcttttttctttttcttttctttctttctttttttttttgtgacagagtctctctctgttgcccaggctggagtgcagtggcattatctcagcttgctgcaacctccacctcccaggttcaagcaattctcctgcctcagcctcctgaatagctggaactacaggcgcatgccaccacgcccggctaatttttttttgtatttttagtagagatggggtttcactgtgttagccaggatggtcttgatctcctgacctcatgatacacctgcttcggcctcccaaagtgctaggattacaggcgtgagccaccgcgcccagccaaagaaactgatttctacttgtattcaggagatatattttccagtgcacagggaaaaatgaactcaaaatttaggatgattgctaaatataatagtattaggtaatactgagtactatgtgcaaggcaccacaaaaaattttaatgtagtattaactcatttaattttccctatgaaataaattttttattatccccattttacagatgaggaaactgagaggaagattaagtactttctaagaacaaacaagttagtaagcagcaaagcaggggcacaaactcaggagtggttatcaatgaccaaattcagccatcaaccactaagttaaattgctgtttatatatctcagtattgtattgtatctatgttgatgcaatatttattttgtgttttttttttacctgagaattaaaaacaaaccaaaagaagctttagtttaaatcttactagatgcctgaaattgaattcgtttaacttgttttataaagttattaccagtagagcactattgagtttatgcaatacaattatctgtaaggttgtactgcatgttgtattatgtaagctccatattaaaaataacatgaattataatttccattttaagactaatcatactttttgtatggcctcaatagttctcctcgttaaatattttctcagccatagttctaaagctcaagttcttttcctttctatacagtcttataatgtttcctttctatgtattcttataagactctgaacttctattatcattcttccacattacctttcacaattatttgtttcatgcttacttgccttctttacttaattgtaggctccttatgggcaaggaacatataacattttatttcatctttcaattactaacatataggaggttcttaattttttttttgagacagggtctcactctgtcacccaggctggagtgcagcagcatgatcttggctcactgcaacctctacctctagggttaaagtgatcttcttgcctcagcctcctgagtagctgggaccacaggcacatagcacgacacccggctaattttttattttttatttttttttaaagatggagttttgccatgttgcccagactggtctcaaactcctgacttcaagccatccttcccaaagtgctggaattacaggcatgagctgcacacctggccttctggctgcttttaagacctctttttctttggtgtttggcactggtttctttttaataacttacttgggatttggtaacctttctgaagattaaggattgatgtttttcgtttttgttttttgagatggagtcttgctctgtcacccaggctggagtgcattggcaccatcttggctcactgcaacctctgccacccaggtttaagcaatccttccacctcaatctcccaagtagctgggactacaggcacagaccaccatgcctggttaacttttgtatttttagtagagacagggtttcaccatattggccaagctggcctcaaactcctgacctcaggtaatccacccgcctaagcctcccaaagtactgggattacagacgtgagccactgagcctggcctgaagattgatgcctttcaacagacaactcagaaaattctatccactgtctcttcaaatatttctcttcctctgctatctcctttttctccttttgaaaccaattaaacttgttatgcctcgctcggtcttccccatcacttatctttgaaattttctttttctttctttctctctttttttttttttttttttttttttgagacagtctaactgttgcccaggctggagtgcagtggtgtgatctcagctcactgcgatctccacctccctggatcaagggatcctcccacctcaatctcccgaatagctgggaccacaggcattcaccacaacacccagctaatttttgtatttttttgtagagatggggtttctccatgttgcccaggctgggtttcgaactcctcagctcaagcactccacctgcctcagccttctaaagtgttgggattacaggtgtgagccactggacccatccccatctttgctattttcttttttcttttctttcttttttttttttttttttttaagaaggagtctcgctctgtcgcccaagctggagtgctcggctcactgcaagctccgcctccgggttcacgccattctcctgcctcagcctcccgagtagctgggactactggcgcccgccaccacgcctggctaatttgtttgtattttttagtagagacggggtttcaccgtgttagccaggatggtctcaatctcctgacttcgtgatccacccgcctcagcctcccaaagtgctgggattacaggcgtgagccaccgagccgggccaatctttgctattttctatctgtgtttctttgggctgcattttagatcatttatttagacttatctctcagttcactaattttatcttcagcttatgtctaatatgctaatttcattataaaattttccatttataaaagttctattttcttctttttcaaatatacttttccatgtatcgtattatctttactggaaatagttattcttactttctgtgtctgttccattactttcagatttcagggtctgttactgttcttggtaccttgttcccttatgtgttttgtaatatttttattgtaagttgcctgtttttcttggaaagtcatctgtgagacttgtactatttccaatgagaaatctaccccatcctaatcatggtgcctgtgttatctaatggtttttttttctctgagtacttttaagatttactctttatcactggttttgagcaatttgattgtggtgttcactggtttaattttcttcatgtttcatgtgctttgaggttcattgaacttctttgtaggtttatagtttttattaaatttcaaaaactttcagctgttactccttcaaatgtcttctgtccacctcattttctgtctgccctattcagattacagtgcattgaaagaatccttcattgttattgatactggccttcagagtctccaattccgcctgtttcttgaagtcccacatcaaactgatgctgtgtttattttttcttatttttttcttttttcttttttctttttgagacagagtctccccgtcacccaggctggagtgcagtgttgcaatctcggtggctcactgtaacctctgccttccgggttcaagcgattctcctgcctcagcctcccaagtagctgggattacaggcgcaggccaccacgcccagctaatgtttgtatttttaggagagatggggtttcactgtgttggccaggcagatcttgaactcctggcctcaagcaatccgcccaccttggcctcccaaagttctgagattacaggagtgagccaccacgcccggccctcatcttgtgtttatgatttttgtttcttttttctctgtgtatttcatcttgaatactttctattgtgtcttcaattcacagatgttttctctgtaatatttaatctgccattaatcccaatcagtgtatttttcattgtacacattgtagttttcatctctaaaagtacattttcaatatgtctacttaactttttgaacatacagaatagttataactgttccagtgtccttatcttttatgtcaaccatgggtatcagtttggggttgattttgattagtcgccttatgatgagtcatgttttcctgcttctgtgcatgcctggtccccatcaagcattcagcagaatgctgagtttcatatgtgtataagaaaattacctgaatctgaggaaagatgttaagaaaagattaggaggaatactgcctaacattcacatacggctgcaaatagtggctgttcccaccagccaggctgaaaagattcataattcatggagcattgagaagagtactcaggaaggtcttgcctcagtagtgaggaataactagccccagactgaacattgttccagatccacctaaaaaaatcataaaagcaacatctgaaagaatcagactatttcaaagtaactaactgcatcccagaacaaagctcaagatttgtaggaataagaaatacctagaacccaacaaggtaaaattaactacatgtatctctatttttgaactgcatttctttaattaacgttgaacacctttcatgtgtttataaaccacttttatgtcttggtgtatgtgaactacctgtttctgtcctttacccatttcttttttgggttgtgatcttctttgttaggtatctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggaggtaagaattttaaaatgctttatatatgtaatctttgttttctgtttatcttattatccttgttttttaatgtgcttctaatgttttggtattctgggttttttttttttttctaatatgtggagtagaccattgatcattaccatgaatacaacttgtgtattacaatgttgctgtcttattatcaccataactaaaaactgtcaaccgggcaagccctgctcacgcctgtaatcccagcactttgagaggctgaggcgggtggatctcctgaggtcaggagtttgagaccagcctggccaacatggtgaaaccccatttctactgaaaatacaaaaattaggctgggtgcggtggctcacgcctgtaatgccagcactttgggaggccgaggcgggcagatcacgaggtcaggagatcaagaccatcctggccaacatggtgaaacccgtctctactaaaaatacaaaaaaaattagccgggcgtggtggcaggcgcctgtagtcccagctacttgggaggctgaggcaggagaatggtgtgaacccaggaggcggagcttgcagtgagcagagatcgcgccactgcactccagcctgggcgacagagcgagactccatctcaaaaaaaaaaaaaaaagaaaagaaaagaaaaagaaaaatacaaaaattaaccaaatgtggtggctggtgcctgtaatcccagctacttgggaggctgaggcaggagaatcacttaaacccaggaggcagaggttgcggtgagctgagatggtgccactgtactccagcctgggcaacagagcgaaactccatctcaaaaacaaacaaacaaattgtcatttctatttttcagagcagcctacttctatagtaagtactttttttttttttttttttttgagacagagtcttgctctgtcacccaggctggagtgcagtggtgcgatctctgctcactacaagctccgcctcccgggtccacgccattctcttgcctcagcctcccaattagctgggactacaggcgcccgccaccatgcctggctaatgttttgtatttttagtagagacggggtttcgccgtgttagccaggatagtgtcaatctcctgaccttgtgatccgcccgcctcggcctcccaaagtgctgggagtacaggcgtgagccaccgtgcccggcttatagtaagtacttttattttagtgtatttcttctgtctaaaggatcatcaatatattgaaaaagggtgatatgaacaaaccaaaatatcttatttaggattacaataacactggagttgaataataatttctgctcaataaagtatgtgaaatttcaggttcccaaaattgaaacactatttaacacatatattaaatggtatacaatttaaatattctttaaaatcataactcttttcacaaagaatatattgtttccttaatgccaaatcttttaggataaatcagcaagacactaaaaatttaataatcagttattttaccaaatgttctggtttttaataaagtcactatttcaaaccacagaaaaattctagagtagaaaattaaatggaaagcagtggtcactgtaagctctagtattagttaagaaaaatttgataaatgttgatatacttgcaaatcttaagatttgatagaattaacttattcattaatatacattgatttagtgagcacttagtaaatacataccagaaactatattatttcttttaatttaaaaagggcaggcaggcatggtagctcacacctgtaatcccagcacttttggaggctaaggtggcctggatcacttgagtccaagagttcaagaccatcctgggtaacatggcaaaacactgtctccacaaaaaatacaaaaaattaggtaggcgtggtggtgcacacctgtagtcccagctacttgagaggctgtggtgtgagaatcacctgagcccagaagattcaggctgcagtgagccatgattatgccactgccctccagcctcagcaacagagcaagaccctgtcccaaaaaataaaaataaaaaaggcttgaagcaaaaatagcagtattacatctattaattctaggcagtagggatatggatgtttgttatattattcctaatgctttttcataattttaaaatttagcaacatttaaaaaaattaatggaacttgtttttcctcttcaaaaaggtcaccttatttaaatgaatttaattccattatccttatcacaatactttgtttccttctgtagcactgaataaaatttgtaattatttatttgcttatctattgtctaaacaataaactgtaaatgtaatgaagtaaaaaatctagtacacttctaatatctcccatctctgtcctcacacttcaattacaacaatcatgcattactctcttttactgagaaaagagaagcagtagaacagactgtccacgtgctcacatcttatcgtctatcctacctacatgcgtacccctatattctgccttccctttgttactgtgaaagaacgatctttgctcctatccaaatccattccctctacttgtgcactagatctcatcttttcttgctttctcaaggacatcacattccagtaattgtcccctttccagcatttcacattttttattttattggatcactgccatcagaatgtagaattgctctaagatatccatcaataaaaacaaaaacaaaaactttatcccccagctaccactacatttctctgctttgcctcccttataaccaaactccttgaagaattgcttgtattctatctctacttctgttctttccattctgtttgaacctgttatataaagtatttttcctatcattctgtagaaacttgtcaggccaccaaatatctctatatggccaaatcccaaggttaatttgtattcctcaatctactcaatttagcagcatttgacactatccctcatttcttcctgaaacactgtcttcacttggttttgaggataccaggtttttttcagtcatttttgccagttccttttcacctcaccaacttcattagagtgccccagggctcagacttaggatctcttctcctttctattggtattaacttattaggtgaccccattcactctcaaggctttaacactaacaactaataatttcttccaattccagatctgcatacgaaatcgcctgttggtattttttgtctaattgatacctcaaacttaacgtgcctaaaattgaactcctgactccttgacacagacctccagatttgctcctcctgcagtcttccacatattcataagtagcaactctattgttttagttgctcaggccaaaaaattatttccatttacccttctttttcttatatttgtaccttgaaaaaatatccagcatcctaccatttctcaccacctccaccactaatactatacttttattgtcacctcttgccttgattactggcataagtttccaaatagtctctcccacccccaccttttttttttttttaaagacagggtcttactctgttacccaggcagtagtgcagtggtgagatcatggctcattgcagccttaacctcctagactcaagcgatctcctgccttagcctcccaagtagctgggactacaggcatgtgccaccatgcccagctaatttattttttgtagagatggggtctcgctatgttgcccaggccggtctcaaaatcctgtgcctaagcaatcctcccaccttggcctcccaaagtgctgggattgcaggtgtgagccaccatatgcagctataatctattcttcatacagctgccagagtaattttttttttaggtaagtcaaatcatgacttctctactcaaaagcctccagtgtcttccagccttacatagggtaaaagagaaagtccctgtcatggtcctacatggtctatcagccctcctcccttatctctttgatttcatctcatatctttgctcttccactcaagctacaccggcctccttacctcaaagataccagttacactcccatctcatggtctttgcacttactattcccataacctggaatgttgttccccaaatatcagtatgcttcacttcctaactacgttcaggattctgcttaaatgtcacctcagagagacctttccttatcaccttatatagagtagtatctccctccatggaatagaagtgtccagaaatataccgtcacaattatgttcaattgaattttgacaagggtgccaagaaaattcaatggggaaaatgtagtcttttcaacaaatggtgctatgacaactggatatctacaagcaaaagaatgaagccgaacctctggtttataccatatataaaaattaactcaaaatggatcaaagacctaaatgtaaaacctaaaaccataaaactcttagaagaaaacataggggtaagtcttcgtgaccttgaattaggtttcttagacatgataccaaaagtaacatgtaacaaaagaaaatataaaatagacatcatcaaaattaaaaccttttgtccttcaaaggataccaagtgaagagatgacctataaaatgaaaaaaattttttgcaagtcatctatttgataagggtcttgtatctagaaatataaagagctttacaacttaataataaaaagacaatcaatttaaaaaatgggcaaataatccaaatagacatttctccaaagaaggtatgcaaattgctaaaacacacacacacacacacacacacacacacacacttgaaaagatgttcaacatcattagctgtcagggattgcaaatcaaaagcacgatgagatattacttcacacccactatgatggctataaacaaaacaaaaataaaagtattgaagaggatgtggagatactggaaccctcatacacttcttatggaaatgtaaaatggggaagttgctttgcataacagtctggcaattcctcacaaggttaacatagagttaccatatgatccagcaagtctagtcctggctatatatgccaaagggtaaaaacaaaactatgtccacacaaaaaactttaacatgaatgttcatagcagtattcataatagccaaagtacaaacaacctgaatgtccatcagctgatagaatggataaacaaaataaggtatatccctacaataaaatattacttggcaattaaaaggaatgaagtacctggttcaagctacaacgcagataaccttgaaaagattatgctacataaaagaagcctgtcacaaaggacgacatattgtatgattccatttatatgaaaggtccagaatggacaaattcaaagacagaaagtagattagtagttgttatgggctgagagaagggagaaaatggagtgtgattgctttatatatagagtgatgaaaatgcttcaaaattgaccgtggttatggttgcttaactctgaatatattgaatatcattgaattgtacatttcaattgggtgattctaaggtattttaattacatttcaaagctgttaaaattaaaagtagttcctcccactattactctgtattccctttctcagttccaattttcctcatagcactcaaccatcatgtaacagactgctttttacttatttatcttgttaataaatttcctcccactaaaatacagattccaagagagcagggtctttattttgcatttgtttgttttgttttgtttttgtttttgagacagggtctcattctgttacccaggctgccagctgcagtgtgcaatcgtagctcactgcaaccttgaactcctgggctcaagcaatcctcccaccttggcctcccaaagttctgggattacagatgtgagccatagtgcctgacctttttttttttttttttaagacagagtttcattctgtcacccaggctggagtgcaatggcgtgatcttggctcactgcaacctccacctcctgggttcaagcgattctcctgcctcggcttcccaagtagctaggattacagctgggattacaggcatgcgccaccacgcccggctattttgtatttttagtagagacagggttttcaccatggtggccaggctggtctcaaactcctgatctcaagtgatccacctgcctcagcctcccagagtgctgggattacaggcatgagcgcccagccttattttgttcttattctatctccagagcctagaacagtgcctggcacatagtgggtagtcaataaatatttgttgactgatcaaatgaatggaacttccaattctttttcataccttcttatccattaaatagggaaacaataaactataaaataattattcactgagctcactttgcactgccgcttactccagtggcagatagagaagctgttttttggctgttccaacaaggtacatttgaatcctgtaggcgtatagaaaaggtaactgcctagtagattttatcctgttctgttaagtgttcactggacaactactttatgaataacacaccaagttcagtgccctgggagtttattgtaaagaagtattatatcaccccattcccattcctgaaatagcaagacatactgttgaaaatgtaactgttctatacatttgttactgaaagcctggcatactgccaaacgaaacatttctttagtcccatatcctaaaataacctcaagttaagatagtagctacaaactagcttataataataatactttacatttgcacagtgctttacaaattatgacttttacagaaattatcacacaaatagctgtgggggtggtggcatcctcatttcacagctaatgaaactgaggaccgaggaggctgggatttactcaaaatcatagaagttgcagagccagaacatctaatgacttcctagtgttctcttttttctgtgacatctagcctccatataaacctctcatattggttagtttagaaaatgcatttatttcttgtcttgggaattaaatagccgcagtattccctccatttcacagatgcaaaaactgtggcttagtaagattgtgatttgtccatggccatgaagttaataagtagcagatactaataacttagtgctctttgaattatacaccactgacataagaaagaacatgtgctgtcttttcaaatagtgagttttgtaattgtctcttttctttttttaatcttggctgcaaagaagctaaaagccaggtattatccttgaccacatcaactctattacattttattactggcatgtctgctttccccttttagtcgaaatttcccttttgggtctaagctcaatgaaattttttccccttttttctcagctgcctcattcctttttggaaagagatgggttgtgattaaattggaaaatatatatagggcttctccagaaaagagtggactatttctttgtttattctgattttatcttcttacctgatgatcttatcaacaactcctttaaggtgggatttatttacattggtgatggcttaatttctaaactggttcacacattagggaggatgcctatctaatgagagagttagactacacttccagcccctttcatgcatcatggagggtagcaatttaatcaagaagtttttctctattcccgttaatactctggccaagatgccacaatatcatcatagctgagttcttcactatctattacttgattccagattaggaatttagaaagcaatgagataagtagtgtgttttgacagaataatccaatgacagtatgcaaaagagatccaatatagggaatgtattggaaactgctaaacttgctatagctggaaacaaggttgtgaagaaaattgatagcagtgctgaagaaaatgaaacagatgttagaaatgttaaaaaattataattatcattacctggtaaccagttggatatagggtacatgggagagggaactgtaagtttcaaatatatataacaggaagagtaatgggttccataatggaaatagggaagcctacagaagcaaactggattctttgggaagataaggaatttggtatatagacatgaatgtaaggcagtaactggatataattaaatgaatggtcaacaggtatggtaaaagtcattacgtataaatgatgcttcgagtatttaagagattcaaggtcaaagtaatattaatactttttaagaactttccaggcactgttctaagtattgcccatgtattattaactctcacaattcttagatctagctaggtaatcccagataagaaactaaggaacagagaggttaagtgacttcttcaaagacacacaataagtaaagcagcactccagtattcaggcctaggcagtctgactccagagtcagtgcttttttttttttttttttttttaattttttcatgcctatccctgtctgctccccattcctccccattctcctccctgccagggagaggagaagctgactgggttggttttgacagtcagtgcttttaacacctatattatactacctcttgagatcacagacaggtagagtatatacacagaaaaacagagggccaagtatcaaattttaggaacactgacccaaggcaccccccaatcactaaaaatgacaaaagaataagataaagtaaaaaagggggatgtttctagtacatcaactgctactagtgtttcagagaagtccgtttcatagaatcacagcattgggggactgaaagtgacctattttctcatataaaagacaccctatggcccagaaagttgtgtaatttgcccaaggtcatagaagtaacggattttttttttttttttttttttgagatagtttcactgttgtcacccaggctggagtgtaatggcaaggtgtaagctcactgcaacctccacctcccaggttcaaacgattctcctgccttagcctcccaagtagctgggattatagacatgcgccaccatgcccaactaattttgtatttttagtagagatggggtttcaccatgttggccaggctggtctcgagctcctggcctcaagtgatccgcacacctcagcctcccaaagtgctgggattacaagtgtgagccactgcacctgccagagtaacagaattaagatgaaaatctagctctcttgaccctggtagttttatttttaattcacttatcacagtaaaattctaattatatgattatatgtgtataaaatatatgtagacatatttaaaaataaccatgattgtgtattttcctaggtgggttagtatgtggagagactatgatgaacttattgcaaaaataacagtttttggctgagcgaggtggctcacgcctgtaatcccagaactttgggagggcgaggagggtggatcacttgaggtcaggcattcaagaccagcccggccaacatggtgaaaccctgtctctactaaaaatacaaaaattagctgggcatggtggcaattacaggagtgggccattgcacctggactttctaaatgttttgaaaatcactgctctaggcaattaataaggctctgtccagctctcgaatgttacagttctcatttactttgggtcattgatgactgtaactaaagacttttgcttagaatgcttagaagttttagatttcatgaggttagcacatatgtacagttccccagcttgacttaaataattgtcatttgccagatcctcactatgtgatgattttactcatctagtcctcagaataatcctgtgaagtagatgatatgcccattttagagatgaagaaattgagtcccagaaaagttaaataacttgcccagtattatacagctagcaagtggcagtgccagggtaagaaaccaagtgtacccggactctaaagcccatgttttatttaacaaaccttatagaacaatgcctggaagatagtgaggctttataaataatgcctcatctgatcctcgcagcaaccctctaaaatagacatttattatctccatgctgacaaaactgaggaacagcgaggttaaataacttacctatgttcttattcaccatatctcttgtcataattgcagacattttaagattaccataacacacatagctgggaaccttaattatttttatttttacttttattttttgagacggagtctctctctgtggcccaggctggagtgcagtgacgcgatctcggctcactgcaagctccgcctcccgggttcacgccattctcctgcctcagcctcctgagtagctgggactacaggcgcccacaaccacgcccggctaatttttttgtatttttagtagagacggagtttcaccgtgttagacaggatggtcttgatctcctgactttgtgatccacccgcatcggcctcccaaaatgctgggattacaggcgtgagccaccgcgcccggccaattaactttttttaacccaatacattccaaagttaagaatcacatattgttttggagtaactgtattatctttcccaaacttagaatattcagaattaaaaaataaataccctgacaacctggaagattgcttcagtcctatttcctgtttaaaataatttactttgtcaattattgtcttaaagatccaagcaatgagtcactttttagtaatattgccttatctggaagtgctttgttttttaaatcagcaatttggatttttatcttcactttagagacagttgttcttgagttataagttttgaactcaattttagtaaattttgaaatattactaaaattctaaaagttagctttctattataggttatggccattgcaccaacccattatatctggcaaagagaacgttctgttcatcacagtggagctgtcagaaactacaacagagatgaagttcagctgccccggggacctagtgccacaccagtagattgttcactctgtggtaaaaaaagaagatatgttagactgggattgtcttcatcatcatctttatccagtcatacagcaggggtgacagaaaaacattctcaggactcatacaactcactgtcaatggacataataggtgatccttctcaagcttatactggttctgaaggtatgatttagtaatatgccagaattagatttatgcatgttgtttactgagctctagtcagtcctttctggcggggatacataataatttatatactccaacaatatgagttaaattaatcttgaaactttctcccctttcagttactttttgtcttgtgtccatatttgttttgtggtgacccacctaaacagatttttaatgtgacctatgttaagttgaaaactaatgcaccataagcctcagtattttaagagcctgaatcatttttttgaaatgtttattttattcaaaagggtttcaagaagaaaataaatttacttgtaatctcaccttccaactattggtttccttctgtatacttttctaacaaaattagaaccatactatatatctaggcctgcttttttcatttatcacgaagtattttcccatgtcattattgagtcctccaaaaccagttttttttttttttttttttttgaaacagagtctcactttgtcgcccaggctggagtgcagtgggacaatcttggcttactgcagcctccgcctcccaggttcgggtgattctcatgcctcagcctcctaagtatctgggattacagacatgtgccaccatgcccagatagtttttgtgtttttagtagtgagggatttcaccatgttggccaggccggtctcgaactcctggcctcaagtgatctgccttcctcggcctcctaaaatgctgggattacggacacgagctaccgcacccaggccaaaacctgatttttaattctgacatggtataagtaccataatttctttatatatttcattttgttgggatttaagtggctttcagcaatagagtattaattagaaaagaaccttattagctgaaaaaatacaactgcaccataatttcactcaaattatttttatatatagtattatctgacatttcttttctagaaatgtctagaaatagtactagaataatattctactatcagtgatcctttttacttacaaagccttccagattttcacccatctcaagacagggtggacagatttttcatggtcctttctaattctatcatgagaaattaacacacctgcattatttcaaaattttacctatttgtttttaccacaaagatattaatagtggctactgaagctttactaaaggagaaactagactctaagattcttgaaggtaggggttatgcctcagtcattgttccatttcttggccatagtaatcactcaacaaatttgcacgacagtatagtctcttccttttcaacaccttcaggcatattttttattatgctgaggcaagaggatcacttgaggccaggagtttgagaccatcctgggcaacatagcaagaccccatctatttaaaaaattgtcttttagcatccctcctttcccagcttcctttactctttgatccttataataggtaagctttactgaatgtttacaatgtccaaggcaatatataatgcattttatattcataatatcatttaatattcacagccaactttagggtgaatactatacctccactcagcagataaggaaactgaagcttagagaagttaaataatttgcccaaggagctggagtgacatgtgaaccccggtctctgactccaaactagagcctgaattcctaaatattatggtctactgcccttttgatgcaatcctgctgttggcagtgaaaataagctgccacggaagccttctagcagactactaaggaggtggcgaaagcattaagatctaagtccctgatgaaaggctacatgaagtgagctgggagagaattccaagaatttgaacagatatttacagaaagcaaaacagaagcagttatacatattttattcagaccaaccactgtaggtatcaacagtaataacactccacagtataggccttgacatctcaacaggaaatttgagtgcacctggggaagaaggggctgtgccagtcagtatactttggagaaaaaataaaggtctttgagggattgtggatgaaaagtggggtattaacttaggggagttgtagaaggaactgtgtgctttcatcctttcactgggtgaaagccatgatttaggatttataggtcctatacaggaaggaacaagtatttacccatagccattttattctgagtattaacccatggttaactgtaaaactctttgtttcaggatgtcagagtgtaagcaatataaaggaaaagtattgattgtacacatattttaccagtaaaaatatacattcattttcctccaatagttttaatggagagtgagctcactgggagtagaggggagagtgcaggataataggaacacatgatgctacaggagtgggataagtctctcactgcctaaacagctgctgatttagtgacctctactagcaaaattttcttcctccattccacctaagattggaatcatctgatagtatgtggttgcaaaaactgaattcagcattctccaagaaagacacaaaagtttatgctctgctttagacttctatgcgaaacttagcatagatggtgatcagtgcttccacctttctttcaaacacaagcaaacaactcctcaatttgcaggtaaagacatgttttcctaccttaaaattttttttgttaaaaacaacacattcaaataaaagttttagataaacatgtttatgacatttattaagaacaaaatatttttcaatttgacaaggtggggtaaaaatactgtcaaaaatttgacttttggggccgggcacggtggcttgtgcctgtaatcccagcactttgggaggccaagagggggcggatcacctgaggtcaggagttccagaccagcctggccaacatggtaaaaccctgtctctattaaaaatacaaaaattagctgggtgtggtggtacatgcctgtaatcccagctactcaggaggctgaggcaggagaatcgcttgaacctgggaggtggaggttgcagtgagctgagatggtgccactgcactccagcctgtgcaaaaagagcaaaacttcgtctcaaaaaaaaaaaaaaaaattgacttttgggaaagatagatgaagcattcttttttttttagatgaagcattctttacatatttatatacatcacaatcaccaatcacacgctagatacttaatctcatttaacatccaaccccctaagaaatcttgaagtggcattattatattcattttactgatgaaaaaacaaactcagaaaagtcacaccattaccaggtaaaacaataacagaaacaagatgggaacccagttctatctgaatatataacatatttttataataactaaactactattgtttctccttactgtatgctgttgtaagctttatgacgcctgggctggtccatgtgaaacatagatatatattatgtattatctgaggacccatgagattttagagtgaagccaagggaaaaaaaaatatgccaagctttagccctggatcatatagggaggcatgtaacattacaactgttaaataatctaaaaccaagtaatttttcctcagaaataaatccttctttgaattttcttacttatttttgtcattaccactgttctagtcacccaggtttaaaattcttacacttaatgaaggtataattagggcatataagttaataatgtgataagggctgtgctaagtatatgatcaacattgaggagcacaaaagatttcagaattaattctgtggggtgagaggtttggtgaaggtttttcaaagtaagatattagctgggcattgactgagtcctgttttgcccagagaattaagggaagggccttctgaatagcagacagaagtttgaaaatacagctggtccttgacttacctatggttgctatacacattcagtggaaagctgtatcatggtctctcttgatgctgggcagaggcagtgagctgcagcttccaggcagccatgaaatcatgagagtaaacaactgattttcgacagtgtaccgcattgccagatgatgttgcccacctgtagcctaatgtaagcgttctgagcacactaaggtaggctaggctaagctgtgatgttcggtggttagctgtattaaacgcatctttttaaaaatattttttgctgggcgcggtggctcacatctgtaatcccaacactttgggaggccgaggcgggtggatcacctgaggtcaggagttcgagatcagcctgaccaatatggtgaaaccccatctctactgaaaatacaaaatttagctgggcatggtgcgggtgcctgtagtcccagctactcgggaggctgagacaggagaattgcttgaacccgggaggcggaggttgcagtgagccaaaatcatgcccctgtactccagcctgggcaacagagtgagactccatctcaaaaaagaaaaaaataaaataaaaacattttttaaaaatagagatggggtctcacattgcccaggctggtcatgaactcctggccttaagcaatcctccacctctgtctgccaaagtgctgggattacaagagtgagctactgtgcccagccaaatgcttttttcccccaccagccaggatcttgctctgtcacctgggctggagtgtagtgatgtgatcacagctcactgtagcctcaacctcctctgttcaagtgatcctcccacctcagcctcctgagtagctggcactacaggcacgtgccaccatgcccagctttttttttttttttctttttttttttgtagagacttcctatgttgcccagactggtgctggtctcggactcctgacctcaagcaatcctcccaccttggcctcccaaagtggtggggttacagatgtaaatcactgcacctggcccaaatgcattttgacttaatgatatcttcaagttacaagagtttattgggacataactccattgtaagtcaaaaagtctcgatatataaattttctctctgcatccaatgaattaccagcttatctggttgttctttcataatattttgtttctttctttgtttgtttgagatggagttttgcttgttgcccaggctggagtgcaatggtgcgatctcagctcactgcaacctccatctcctgggttcaggcaattcttgtgcctcagccttcccagtagctgggattacaggcatgctccaccatgcccagctagtttttgtatttttagtagagacagggtttcaccatgttggtcaggctggtctcgaactcctgacctcaggtgatccacctgtctcagcctcccaaagtgctgggattacaggcgtgagccaccgcgcccgacctgtctgctcattttctacgattaatcaccttatatatgtattactatgaaagctctgatttaacagttttttcctccagttaaattctcatagacaccactaacagattaacttaaaataccttttacatgaccatagaaacttcagaagttcccactgcctctgaaaatatgaagttcaaaatgaaagcctcccacaatcgcagaactatatactatgtatacctaaatttccctctagaacaaccaagtcaacagataaaacaatacatgacccttggctgggcatggtggctcacgcctgtaatcccagcactttgggaggctgaagcgggcagatcacttgaggtcaggagctcgagaccagcctggccaacatggtgaaaccccatctctactaaaaatagaaaaattagccaggcgtggtggtggtgcatgcctgtaattccagctactccagagactgaggcaggagaattgcttgaacctgggaggtggaggttgcagtgagctgagactgcaccactgcactccagcctgggtgacagagctagatgccatctcaaaaaacaaaaacaaaaacatgatccagtgtaggtttaaagacatcaggaaagttttagtgactatttactgggtataaaaggtagggcctctggaaggcattgggatgacagttttcggtcagtctcaaatctttagtttacaggacagccagacatagacatagaaggctaacattagaaggtatctgtcccataaaccagactgtaaacatacttattgtttggaggaaggctgaagaaagagcttaagctgggccttgattgactagaatggacaactaccaaagaaaaagaagagaaatagaagaaaactacacacacacacacacacacacacacacacacacacacacacacacacacaaagggaagtgaggggaaatgaatggatactgttaaaaaggtcttgttcaattcaacatctactgagcaccatgtgccaaacagaaacaatgtattctccatgaaacaggagccaagggcagaacttttcttggctcttaagccagccccttctcaaagtagacaattggggattgacacaaaataggcattcaaagcattaaatgaataacataatttcattactagctaaatagaagggtagaagaaaagggagtattccatgatggaattaaaaaatggacttcaggccacgtgcagtggctcattcctgtaatcccagcagtttgggtggctgagtcgggtggatcacctgaggtcaggagtttgagatcagcctggccaacatggtgaaaccctatctctactaaaaatacaaaaattagccaggcgtgggagcgtgtgtctgtaatcccagctacttgggaggctaagacaggagaattgcttgaacctaggaggtggaggttgcagtgagccaagaccatgccattgcactccagtctgggcaacagagcgagactctgtctcaaaacaaacaaacaaacaaacaaacacttcagagcttctatatagtcatgcgccacataatgacatttcactcaaggtgggactgcatacaggatggtgttcccctaagattataatggctgggcatggtggctcacacctgtaatcctagaactgtgggaggccgaggcaggtggatggatcacttaaggtcaggagtttgtgaccagcctggctaacatggtgaaaccctgtctcttaaaaaaatacaaaaattagccgggcgtgatggcacatacctgtaatcacaggtactcgggaggctgagaccggggaattgcttgaacctgggagttggaggttgcagtgagccaagatcgtgtcactgcactccagcctgggcaacagagcaagactctgtctcaaaaaaaaaaaagaaaaagaaaaagaaaagaaaagaagaaggatggaaggaaagattataatggagctgaaaaattcctatcacctactgacatcatagacctgtactgcaacacagtaccttttctatgtttagatacacacatacttaccattgtcttataaatgcgaatggtagttagtacagtaacatgctatccaggtttgcagtctagaagtagtaggctataccatataacctaggtgtgtagtaggctataccacctaggtttgtgtaagtacactatgtaatgttcacacaatgatgaaactgcccaactatgcatttaacagaatgtactgccactgttaagcaatgtataactgtatctggaaatgttataaaagctataaaggcatcattattatataaatgttcagctagttacatacagaaatataccaccagaatactctgctcctgattcaatcacttgtctaaatgcagccagagtgattttcaaaacacagatctaaacatgtcaccccttacttaaattcttcaatggaatcccatttttcttaggatacaccaattccttcacgggcatatgagaacttgcatggcctcatccccatctatctatccagtcttttccactctaccccagcatcactttttattcccattttccctgctgtagttaattcctacttagcattcagttctcagctcaattgtcacttgctagggcaaagtcccccattatggttactcatagtaccttgtacttctttggggggaatttataacagttttagttttacatctgtgtgattaatgtcaagctctatcatagactataaactctaaaaaggcagagattttactttaaaatgtcctacgttctataatatgttatttaataaaaaatttacacacatgtataattttaaatacttctagcctaagagataaatctaggaatggtagcatttaccctccaaggcattactattttacagcccataaaacaggccgggcatggtggctccacacctataatcccagcactttgggaggtcaaggcagaaggactgcttgagcttcggagtttgagaccagcctgggcaacatgacaaaccccgtctctaccaaaaaatccacaaaaattggctgggcgtggtggcatgtgcctgtagtccaactacatgggaagctgaggtgggaggcttgcttgatcctgggagattgaggctgcaatgagccatgatcacgccactgcactccagcctatgtgacagaatgagaatctgtctcaaaaaaaaaaacacacacacacaactaaaaacctataaaacatctatatttaaacagagacctaatcattctaagtcactgtttatctgtaaaatatggataacctgaaagataagttgtccatagtaagtgaaaaacatatataaagttttcaaaacaatgtatggtatgtggtaagtgctaaataactggtgcctatgaataataagtcccatttgtaattaattcatgtttccaaaatgtattccccaaacattttttttttaagatggagtctcgccctgtcacccaggctggagtgcagtggcacagtcgcagctcactgcaaccttcgccttccaggtttaagcgattctcctgcctcagcttcccaagtagctgggattacaggtgcccgccaccacaaccagctaatttttgtatttttagtagagacaaggttttgccatgttggccagactagtctcgaactcctgacctcaggtgatctgcctgccttggcctcccaaaggcgtgagccactgtgcccagcccccaaacatttaatttgtgtagtaacactgaataattctaatgttctttcaagctggttaaaaagattctgaggggataaaagagattcaagagcctgttacatcttttgttacaatttttaaggtgattatatcattcttaagtttccccccattatttactgtagcccagatttccttattattttttaagacatatacaagccattataagatgtatttaaaatggacagatacataaaatttatcttaaaatgcatattttatttcagtagtcaatgaccatcaatcaaataaaggaaagaaaactaatttcttgaagaaagacaaatctatggagtggtttacaggaagtgaagaatgagatggcccaactaaaccaatttggaatcattaactacaaaatgtcaaactaactgcaagacaagtgtcaaaatgggatgtttaagcagttttgctatgttatacatcttttagttgttattttcaaaattatatgtataagttatataagtcatagtaatagctaaaaatgccaatctatggaagcagtgattttcaatataaagttctattttgatatttttccatcttcaagtcagttactgtcatctggagtactcagttaagttgtggtttgaccttcctcaacttgacaagaaaagctaatttaagagaagaaaaacataaagtcattatattaattaaaagaaaaaacaccatttaatatgttctgaaaacattactcacctgtatgaccaggttgccagtgtactggtctagcaacatagggaaatgatccatatggaaaatcagaatgcgattcttctgttgtaaaaaaatatatgtactataagctacataaaatattttctatttttttcacaaaactgttaaaatatgagttactctctttattgtaagttttttctttatttatttccttgcatatgttttagagctactctgccagttattatacagaaactatttgtcaatgattatgtaataaacatatgattttataaccaaatggataagcctatatcataaatcaactgatacttgaaaacttgttcatggcctaaataatgtgtatatatgacaaagacctaaactcagttctttcaagaattccagcagcatcttagaagttgctttttggaatattagctatttgcctatcaggtcccattaataatcagtgatctaaatataaaacatccttaatacatttaaattatttcacaaaccaagctccttgtgacaagtaaaatatgaatattataaaaagctcaattcttcaaaggtatcagagttttaagtaaaaggcaggaaaagtcattattctgtgccttatacatcttaacagaataaatatcacacttttctatagaaaattgctgaggaatatttttataatctattggtcagtatactcaggaactcattctccattcattactgcatgcataaagtaaaactgaagctcaccatggtcatcctcttgaaacagctcacctttaactccaattttctcttgagaatctagttgtacatctgtgttgattttagattctactttttgagctaaaattccatttttctgttttgcaaggcaaaccaaccaatctctgacaatgacctcgcttatcttttcacatgaaagagcaagttcacaggtgcgaattccatctaaaagttcaataacctgtgtgatgctttcagaaaagtgaaaaatttacatttctactaaaataataacattatatttatttaagttccctatacctcttgcccacatttaaataccatagttaaattaaggcaggagagggtttaaatatgcaagttaggaggcataaaaagtaccttcacaaaattctaagtaaacaaacacagagaccataatttaacattactgttcacattatacttttaaaacatttcttccagattgtcagaagaaaatatgcatcttatattactatttatgtaaaaaatgatttaaacagtaatatagggttgggcgtgggtcacgcctgtaatcccagcactttgggaggctgaggggggcagatcacttgaggtcaggagttccagaccagcctggccaacatggtgaaaccctgtctccactaaaatacaaaaattagccgggtgtggtggcgcatacctgtaatcccagctactcaggaggctgaggcaggagaatcacttgaacccaggaggcggaggttgcagcgagctgagatcatgacactgcaccccagcctgggtgacaaagcgagactctgtctcaaaaaaaaaaaaaaaaaaaaaaacgaaaaaagtttaaaaaaaaaaaacactaaataaatatacagtaatataaatgaacttgggacttgtcattttaaaacagttgtataagatgccatatacactttattcagttacaaaatgaatattttggctgggcgtggtggctcaagcctgtaagcccagcaccttgggagaccaggtgagcagatcacctgaagtcaggagttcaagaccagcctggccaacatggtgaaaccccttctctaccaaaaatagaaaaaatcagccgggcgtggtggcgggcgcctgtaaccccagctacttgggaggctgaggcaggataattgcttgaacaggggaggtggaggttgcagtgagctgagatcataccactacactccaacctgggtgacagagtttttttctgtctcaaaaaaaaaaaaaaaaaaaaaaaaatttagtttgatacttaagcaaaagtgcacttaaaagttacattacaaagaaaaacagttatattactcactttactacatatacagcacatacaccaccatgcttaagatgtgggtaaaaaacaggcaaagtaacatgaggatttaacatatccaaagctacctgtgtgggggaaaaagagaactggatcagtctgattccgtttaaataaagcataagttttcttattgtggtgaaatgacacacttttggacagcaatcaaagtatttcattttttagaaggtagtattattaactatcattttaccactcccaaaagggtatgttaattattatacagttgggcaatgtggcttctgcctgtaatcccaacactttgggaggctgaggcaagaggatccatttgaggccgagtttgagaacagcccaggcaacatagcgagactctgactctattgaaaaaaaaaaaaagtagctggatgcagtggcacaagcccgtagtaccagctattcaggaagctgaggtgggagggtcactggagcctaggagttcgaggctgtagtgacctatgactgtgccatcatactccaccctgggcaagagtgagatcctgtctcagggaagaaaaaacaatttgtcatagtacttgatgatactgaaaaatcataatgatatgtcttgtactttgcatattaatatggaaatattgatttggctatgtatgtatatatgaatataaccaaagaaagattcctgtatgcctgtattatcaatattgccaagtgtaaaacacgccattacaacatgaaaaatttaaacatttgagacaatgtgaatttcctttttttttttttgagacagggtctcgctctgttgaccaggctggagtacagtggcacaatgtcacctcgctgcaacttccacctcctgaactcaagcaaccctcccacctcagcctctcgagtagctgagactacaggcaggcgccaccattctcagctaactttttgtatattatgtagatacaggttttgccatgttgcccaggctggtcttgaactcctggattcaagcgatctgcccgcctcggcctcccaaaatgctgggattacagatgtgaaccgctgcacctggctgacaatgtgaatttctattgccaaaacttataaatttaaatgctttatttcagctttggcaacagaaattcacattgttggccagaggcagtggctcacgcctataatcccagcactttgggagcccaggcgggtggatcacctgaggtcaggagtttgagagtagcctggccaacatggcaaaaccctgtctctactgaaaatacaaaaattagccaggtgtggtggtgcacacctatagtcccagctactgggaaggctgaggcaggacaattacttgaacccgggaggcagaggttgcagtaagccaagattaaaccactgcactcaagcctgggtgacagagtgagattctgtctcaaaaaaaaaaatcatatcccttatttcctctttattcttgtttcaattgcagtatacatggctatagtcacagaagatgccagtaagtacaaagataagtgaaaatttttcaaataaaaaattaattaaaaacaaaaaataaatctggtcaaaatagaaaataaagtaacatttactgttgtattaactccagaaagcttagagatatgctggcatatctatttactaaatgataaaatattagattgtttgtgtcttttaaaaacagtactaatcagtcaagggacatcttattaatttattcaccaaatatttattaagcactgtctacatggcaaacatttttctaagtggtaaggatatagttggagcttatagtctgtttcacgggatctaatgaaggggtagacattaaacaaaaataagaaaacatataaataaataggacagagggtggtgagtgacatgaagaaaaacagttataaagcagaataggcgtggtaactcatgcctgtaatgccagcactttgggaagccaagggaggaggattgcttgagccaggagttccagaccagcatgggcaacacagtgagaccccgcatttataaaaataaaaaaaatggcagggtgcagtggctcatgcctgtaatcccagcactttgcgaggccgaggtgagcggatcacctgaggtcacgagttcaagaccagcctggccaacacggcgaaaccccgtttctactaaaaatacaaaaattagccaggtacagtggtgcacacctgtaatcccagctacttaggaggctgaggcaggagaatagcttgaacccaggaggcggagttgcagtgagcagagatcaggccactgcattccagcctgggcgacagagcgagactccgtctcaaaaaaaaaaaaaaaaaaaaaaaaaaaaaaaaactgccaggcgtggtggcatgctcctgtggttccagccacttgggaggctgaggagggaggatcacctgggcttgagaaatcaaggctgcagtgagctgtgattgtgtcactgcactccagcctgggtgacaggataagaccctatctcaaaacaaacaaaataagcagagaaagagggaaagaaagggacaggtcagggaaaggaggtgtcattttatacatagactggtcagtgaagagacctgaagaaaataaaattaagtttaacccatgaaaatgtaggggagaagtgagctcctggtggagggaacagcaaatatttaatacaaacactcaggtagtaggctacttggggagtctgttgaggccactgtcactgcagtggagataaaagggggcaagtggtaagagatgacatcgaaggtggtggacacagattacatagaatcatgcaggctttagctttactcaattgagaagccactgaagaattttaaagattgacatgatttgaacttttttaaaaaactatttttgtgtgtggtaaaataaacattgccattttaagtatacaattcactgtcattaagtatactctgactcactttaaaatctacatgcagaaaacactgagaatgcaaggaaggatgacagtggcttgtaatagcaaagagcagtgggtgtggtaagaagtggtatatattttgaagacagagccaattagaattagaattggctgtaggatgtgagaaaaagaaaactgaatccaaagtttttagcctaagccaccgaaagaatggaggtgtcatttactaatgaggaaaatgatgaagattatgggaggagcaagcttgggggaaataagaattcaggtttggacatgtatttaagatgcctattaaacatccaagtcaaggccaggcatggtggctcacacctgtaatccaagcagtttgggaggccgaggcgggtggatcaccttaggtgaggagttcgaggccaacctggccaacatggtgaaaccctgtctctactaaagatacaaaaaaattagctgggcatggtggcgggtgcctgtagtcccagctacaaaggaggctgagacaggagaaatgcttgaaccagggacgcagagattgcagtgagccgagatcacgccattgcactccagcctgggcaacagagtgagactccatctcaaataaataaataaataaataaatatccaagtcaagatttcaatgacaatcaagggtcaacatgatgacataaatgggttctcagactgtagttttactatattattgacaaggaccaaagtcagataacccagaaaactgcaaatcttgaatgctcaattctcagttaacagcatttatccagttactcaaaccagaaacttaagagtcatcattttcttttttcaaagcctaatcaagaagccatcattttctttaccttgaattctcttttgagactctggggttttggtgcttctgtttgaattaaagtctcacaaatctacctccagtgtttctgaaattaatcccacagacattgacttaggtcaacacctcaccatatcttgttgaaatattataatacctttctgcatagactcccagcctccattctttctccagaactattctaaaacagaaatctagacagtctactctcctacttacaagataatgtccatactatccagcttgatatatacacaactttctttattatctagcccctcatgactgcatttacagactcatctcctcataccaagttctacagccatggtgttttatacttctgagtctttttagtaattgctcatatgtctatttcattttatcttatttaattaaattttttttttttgagatggagtctcatcctgtcgcccaggttggagtacaatggtgcgatcgtagctcactgcaacctccgcctcccggtttccagagattctcttgcctcagcctcccgagtagctgggattacaggcatgcgccaccacacccaactaatttttttttatctttagcagagacagggtttcaccatgttggccaggctggtctcgaactcctgacctcatgatccgcccgccttggcctcccaaagtactgggattacaggcatgaaccactgcgcctggccaatttaatttaatttttgagacagagtcttgctctgtcacctaggctaaagtgcagtggcacaatctcagctcactgcaccctctgcctcctgggttccagcgatcctcctacctcagcctcccaagtagctgggattactggcttgcaccatcacacccagctaatttttatacctttagtagagacagagtttcaccatgttagccaggttggtctcaaactcctgacctcaagtgatccacccatctcagcctcccaaagtgctgggattacggccatgaaccatcatgcctggcccacagctattttttttttaattttttaatatttcttattcattttttgttttcaaaagctcttttgaatgtataatttttgtcttagcacagcacacgacacatggcaggttcttaataaatgcctgttgactccagaaacaaagtggttcagaaattcagaggaaggtaataatcctctggctagatgatgaaaggatatttcacacaggagatgacctttaagctttaaagggagaatagagtttaaacaggcagagaaaagaggaaaggaagaaaatcaaaatgatgaaaaacataactaacatttattcagtgcttactatgtaccaggtactttacatgaattctcttatttaatcctcaacaactctatgaaataggtactattatcattcctgtttaatacatgaggtaaccgaggcatggaaagattaagtgacttacccaaggttacactggcgattatggagcccggcagtggaccaatctgaatggaccccaaacttatttccctctattcctttcccttccttttctctcctcagaaagagtcattgtcctgaagttggtaacattcccaaattttatacttctacaacatatgtatatagctacaaacaatacatgttgtgtagttttaaattttacatgtaggcggtcatttcacatattctcttataatgctttttccaccaaacaccaagtctttcagatttattgatgtagctagagtacatttattgttagtattccattgtgtctattctcttttgatggttaagctgtttccaaaatttgtttaattctttttttttttttttttgagacggagtctcgcactctcgcccaggctggagtgcagtggcgccatctcggctcactgcaagctccgcctcccgggttcaggccattctcctgcctcagcctccccagtagctgggactacaggcacccgccaccaggcccggctaattttttgtatttttagtagagatggggtttcaccatgttagccaggatggtcttgatctcctggccttgtgatctgcccgcctcggcctcccaaagtgctgggattacaggtgtgagccattgcgcccggctaattcttttattagtcatgctcttttttctattttttttaatggtttaacaccttttttattcatttagcatcattttggttggcatgtatggagtcaggttacataaaggactagagaaaggaaggttcagatcagatctggccaccagaagtctttgaatgaaaagctccgggtcaggtgccgtggctcacgcctgtaatcccagcactttgggaagctgaagcgggtggatcgcttgagccctggagttcgagaccagcctaggcaacatggtgaaaccccatctctactaaaaacacaaaaactagccagccatggtggcgggcgcccgtaatcccagctactcaggaggctgaggcacgagaatcgcttgaacccgggaggcggaggttgcagtgagccaagatcataccactgtactccagcctgggcgaaagagcaggactccgtctcaaaaaaaaaaaaaaaaaaaaaaaaagaaaagctccggattttttcagcaggagaatgacagtatcagaaatacacatctatacatacatatttgtttatttcttttctgttttttttgagatagagtcttgctctgtctcccaggctggagtgcagtggcgcaaatcttggctcactggaacctccgcctcccaggttcaagcgattctcctgactcggcctcccaagtagctgggattgtaggcgcccaccgccatgcctggctaattcttgtatttttctttctttctttctttcttttttgagatgcagtctcgctctgtcacccaggctggagtgcagtggcgcgatctcggctcactgcaagctccgcctcccgggttcacgccattctcctgcctcagcctcccgagtaggtgggaccacaggcacccgccaccacgcccggctaattttttatatttttagtagagacggggtttcaccgtgttagccaggatggtctccatctcctgacctcaggagatccgcctgcctcggcctcccaaagtgctgggattacaggcgtgagccactgtgccctgccagagatttatgtttaacatatgccttttgatctttgatcaaacaccaaccctcaagcagtactcttaccaatgtacaatttttagaaacgttcttaagaaaaggaaattattcatgatctagcttctacttaacagttctgtattataattatttatgaacaccaactataattctttggtcctaacggtatataactctcccccagcagctgacaccccctctccttctctattccctcatattgagtaatcatctggcactattattcaagagagattcagctgaataaatctaaaaaagagtgttctttttagatcaggaatggttcagcaggtttctacaaagcttcaatgatatcattaaaatcctttgttgtgtttcatgctcatcaagcaaaattctgatgaccaatttaatctcgcaggtatttttgacattcctatggatgacctaaacagagctctttcccccttattgagctgtaacatgcaagccataaatgagaaaaaagaactgaggtctttctgtacaggaagctgtgccactaaaactataggttttagttatatcagagctggaagccagtgctgataaaaatcattttcatggccaggcacagtggctcatgcctgtaatcccagcactttgggagactgagatgggcagatcacctaaggttaggagttcgagaccagcctggccaacatggtgaaaccccatctctactaaaaatacaaaaattagctggccatggtggcgtgcacctgtaatcccaggtacttgggaggctgaggcaggagaatcgcttgaacccggcaggcggaggttgcagtgagctgagactgtaccactgcactccaccctaagcaacagaatgagactctgttgccaaaaaaaaaaaaaaaaaaaaaaaaaaaaaaaaaagattttctctcctctttgaactttgcttcatttctcaccaaaacagtccatccttccagcagccaattaaggaaaggaagaaagactcctaaccaaggcctcagtccatagtgtgaagctatgaactgtgaagtggcatcaccaaggaattctgaaactcttcagccagcaaatacttccatgtcccagatctccaccatgtttgatcgcagcttaatgtatcctctcttgtcatctatctttttactttcatcttctctgcttcttttccctaagtcaacttcccagtgtttctcttcctcacaatgtctctgctccactttctggagctttgttcatgataaacacctctgtcctcgacatcttcaatgaacacactccccttgatatcctgacttcaactaactaaagatgccttctgcctattccctgtcaaatggaagctacttattcccccaaatctcacagttcaggttaggtgccgggttcaatatgcttccaatgctgcttccaaagtatgattcatcctagaaatgctgaggttcatgatgctcaactagtctttggtcctagctttcagtcattaccccacattcaatgacaacttcagcacccaactcggtaactcagtatgtctctctgtcccaaatcccaccatgagattaaaaggcatgaaacgaaaatattctttcaatccctagagatagacatgaagcaaacgaaggaagacctttgcccatacaaaagaagcctgacccctatcttctttatagtcaaagtaataacacaggacccacgttagaaaacttactgcgtcaaatgttaaagattttatgtcttcggttgctcctgaaatgtccttatgaataaaatccacattgtctggccactcttctacatgacttaatttccatgaatcacgccagtgtttgtaattcttcttagccagatcatggtggtcttttcgtacctcaaaacttatgactcgtccttgtgatccaacttaagtaaaaaataatttgatatttcataatattaatcagtttattaaaaagtgtcaaaaatgtattttgcaaaggtactacatgtatgtgaaaaaaataattcaaatagttcaatgttacaagtctgatctcctatccctgatctccaattaatctccctccctcttcagaggcaaccacattaccagctatttacctttcccatgatagtcactgcctatacaagcatgccaagtatctctctgtgtttttaatacacactgtggtgtattatacacactgtcctgtaccttccttcttacttaccaatgtcatttcagtgcttctagatgtactgcattcttttttaacaggcattatattcactgtatggctacgatgaacatttagcttgtttctagtcatatgctaatataaacaatactgcaatgaaaattcttatacctaagtctttgtatcaagccagtatatctctacaggataaagtcctaaaaatggaattgctggctcaaggggtatgtgaatttattcacataatattacattgtcctccacgtaagtggtgtcaacttatatgccaaccagcaatgtattagaatacctgtatctcaggccggtcgcagtggctcccgcctgtaatcccagcactttgggaggccgaggcgggcagatcatgaggtcaggtgattgagaccatcctggctaacacggtgaaaccctgtctctactaaaaaaaatacaaaaaattagccaggtgttgtggcacatgcctgtagtcccagctactcgggagactgaggcaggagaaaggcgtgaacctgggaggcagagattgcagtgagccaagatgcgccactgcactccagcctgggtgacagtgcaagactccgtctcaaaaaaaaaaaaaaaaaaaaaaagaatacctgtatctccatactctccctaagttattgaactttttatctgtatcaatctaaaaagtgaataaagtttatcatttttaatgtagatttttgagtttggtttttttttttttttttgagacaagatctcactctgtcacgcaggttggagtgcggtggtgcaatcacagctcacggcaacccccacctcccaggctcaagcgatcttcccacctcagcctcctgaacagctgggacgacaggtgtgtgccaccacacccagctaactttttgtatttttggtagagacagggtttcgccatgttgccagactggtctcaaactcgtgagctcaagcaatctgcctgcctcggcctcccaaagtgctgggattacagacgtgagccaccatgctcagccttttaatgtaattttaacttgcatttcttttattatggatgaggttgagtctttcatatatttaaaaggtatttgtggccggatacagtggctcgccacagtaatcccagcactttgggagggcaaggcaggcagatcacttgaggtcaggagttcgagaccagcctggccaacatggtgaaaccctgtctctaccaaaaaataaaaaaaaaaaattaaaggtatttgtatttgtgtgtgtgtgtgtgtgtgtgtgtgtgtgtgtgtatgtgaagaacttttaaactaattagcacagtaatactgcaattccagagaggagtactacattttaacttaaggcaattaactttccacccacctctatctgaagtgatttgataccatttggagattatcccagatcaatcagtttacagtttactaatgaagtttaaattccaaggtatcttttgaaatgtaactccaactgcaagttatcaggttctcaggagataaaaattaattttaatagtaacataagctgggcgtggtgccccatgcctgtaatcccagcactttgggaggcttaggcaagattgcttgaggccaggagttcaagaccagcctgggcaacagtgagacccagtctctacaaaaactttaaaaattagccagctttggtggtatgtgcctattgtcccacctacttgggaggctgggacgacaggatcacttgagttccgagggtcaaggctgtagtgagccacgatcataccactgcattccaaactggggaacagagtgagaacccgcctcaaaaaaaaaaaaaaagtaacataaacaactggaaaagaaaatatggagaaaaatatccatcacataggtaaatagcaataagttcttgcacatttatagtttaggattattcaagccatgacactcttctgatactatatattttagaaatataggcacttatctgttctcaccaatttttataaatccactttgtcaaatgaaaccgtgcagttaggaatttgtcatagatgatgagaaaatgactgcctttaactatgtacagaaaagtcaaacaaaagattgattgaggagcccagaatgaatttaccggcttagtataatctagataatattcatatgtgaagacattaggtcaaagaacaaaaggtgtgagtttaatttcagcatatttctatctgtaatctttataaaatctactcaaagaaagtactgtgactattcagcagtctagtattatgtagggaagagaacactgcacagacagaccacccaaagcaaccctgacactcagagaaattaggtaggcaaagaggtactaatcaactagcataaaagtaactagaaattaagtggtaggaacatgaaaaaatatatatgtttaatatacacctcttgatttttgatcagacacccaccttcaagcagtacttttaccaactgacaatttttagagactttctggaaaaaaaaaagataattcttcatgatctagctttttacttaatagctctgtactatgattaatttctttatgaacacctactataattctttggccctaacgatatataactctccccccaacagctgacaacgtccttccatattccctcaggctaagtattcacctggcactagtattcaacaataacatgacaagtacacaaggaggttccaagcagcactatttgtaatatccaactcaaatgtctatcaacagtaaaataggtaaattgtgatttaaatagagagtattatacagcaactaaaatgaaagaactactgctgcatgcaatgagtgaatctcacaaacataataatgaatgagagtagccagatacaaaggagcacatactgtatgattccattttatataagttcgaaggaggcaaaactaatcagtgatgataaaagtcacaatagtggtttcctttggtgatgataaggactgggaggggacatgaggaggcatctgtggggcagggacactccctaccttgatctcggtaataagtacatgagtggtcactatacaaagattcattgagatatacacttatgatctgcacacttttctgtagccatattatattccaataaaaagtatacttaagaaaaaagaagcagcattagagagcatggagaaagtaaaacaaagcaaagaaaattgagggaggattagaaagagactgactggaataaatgtacagaatggaaagaaaaatagttgcttactttcagattctaggagaatgctacctcaatgttaggtattttcccaaatatctttatacctttctgttattatgaacaaattgaatgttttctttgttactgagatccagctcagtccaatctcttacctgctttggataaaaataagctcattccaccagagcctgagccagcttccaaaacagtatcacctgggttgatatccatcattgagagaatcatattaatatcctatgattgaaaacagtatgggtgactcagcgaccaataaatatgtactaagcacctagtcttatcttacattgttgggtgtgcagaagaagggagtgaaaaaacgaatcagactctggacctgccttcagtttatatttcacttgatgaaataaaagagatccaagaatcaattaacaaataaggcaacacttcagaataataccaaaattacagacaataagttcatagagtagcaggatggcctagtttaaagacaaagagtagacaatttatgggaacaatcacaaggtaaaaacagctttaaacaaagcagaggtagaataaatccagtttgttatctcaggagagataggcagagaattaaatgccagtatgaggcattagaactcagcctgataagcaactagggtgtgtcactgaggtgatataaatggcattttatgaggattaatctggcagaagaatacaggatctactggagaaaaatcaagaggcaggaagaccagttaggaatttactatataatctctgcataaaatgatgaatttcctttttttttttttttttttttttgggagacgaagtctcactcttgtcccccaggctggagtgtgatggcacgatcttggctcactgcaacctccgcctcccgggttcaagcgattctcctgcctcagcctcccgaatagctgggattacaggtgcctgccaccatgcccggctaatttttgtatttttagtggagatggggtttcaccacgttggccaggctggtcttgaactcctgacctcaggtgatccgctcgcctcagcctcccacagtgctgggattacaggtgtgagccagtgtgcccagctcaaaatgatgaacttcttatttttggggggacagagtctcgctctgtcacccaggctggagtgcagtggtacaatcttggctcactgcaagctccgcctcctgggttcaagcgattctcctgcttcagcctcccaagtagctgggattacaggcacccaccaccacacccagctaattttttgtatttttagtagagatggggtttcaccatgttggccaggctggtctcaaactcctgatttcaggtgatctgcccgcctcggcctcctaaagtgctgggattacaggtgtgagccaacgtgcctggccaaatgatgaacttctaatttagaattaagatactatataacagcggtccccaaccttttgggcactagggacccgtttcgtggaagacagtttttccacagactggggagagggggatggttttgggatgaaattgttccacctcagatcatcaggcattagttagtttcttataaggagcatgcaacctagatctggtgcatgcacagttcacaagagtttgcactcctatgagaatctaatgccatggctgatctgacaagagatggagctcaggcagtaatgctcactacccaccgctaacctgctgtgtggcccggttccctgttacaggccacacactggtaccagtcctcagcctgggggtaggggagccctgctatataagaaaaaaaagagactatgctattactagattggaggacccacttgccaaacatataattggaattgtttttgttaacacaaatattacggatgatattaataaaaactgtttttttaaatttagtaaacaaattttcttggtgacagggtctctgtcactcagactggagtgtagtagtgcaatagtagctcacggcagcctcgaacttctgggctcaagcaatcctcctacctcagcctccaaagtagctgggaccacaggcatgtaccaccatgcccaactaattttttttttattttttataaagatggggtcctgctatgttggccaggttagtcttgaactcctagcctccagcaatcctcctgccttggcctcacaaagcactgagattacaggtgtgagtgacggcacctgccccctcactttttttttgagataggatcttacactgttgcccaggctggagtgcagtggcaagatcatggctcgctgcagcctcaaactcctgggctcaaacaatcctcccatctcagcctcctgcgtagctgggaccacaagtgtgtgccagcatacctggctaattttttattttttgtagagacaaggtctccctatgttgccccggctggtctcaaacttctgggctcaaatgatcctcctgcctcagcctcccaaaatattgagattacaagtgtgagccactgcactctgcctctggtcatatttttaatactaagatggaattatgtaattctaacagggagatcagtttttaaacatcagtgaaggtattccctcaagcatttcaaagttgtagaagttgaagtaaaactatctccagccattacttggaagctataaagagaagtcaacacctaacaaatttagtacttaaattcctccttagagtggaacaatgtgacttttatctgtaacaaatggaaaggcagaaagtatactaaatatgcatatttataacttcatgaaatgtaactaatctctcctgattttgtctaatggggagaaaggagacacggggaagcaagataaaattacgaaagtcttttagttttcttcaagagcttatgataccatggccaggagcggtcgttctcacctgtaatcccagcaccctcaagggaggatcccttgagcctagagaagtttgagaccagtctgggcaagttagggcgaccccaactctacaaaaaaaatttttgattagctaggcatagtggcatgcacctgtggtcccagctactcaggaggttgaggtgcgaggattgttggagcctgggaggttcaggctacagtaagaggtgattgagccactgcactctagcctgggtgacatagcaagaccttgtctttaaacaaaaaaagcttattatacctcagtagcctaagtttctgaggaaagtttttttagtccctgggtagaccgtttaaaatacagactggattcctactaagaaccttctaatggtccttcactacaaatggaataaaatactcaaaccacacctcatacggggtccctcatctgacccattgaggccacaacagaaactctgcagcattcctccctttgcaagaacaattctcttcctagatctgtttacaaggcaagctcttccttatttaggtttcctatcaagtgtacctccttggagaccatctctcctcacctgacataaagtatgctcataccccaggtcacccaaaacaatgtcattgttaatatatttgtcttcatgacacttaacactactggaaatgaccttattctttcatttacttgtttgttctttgtcaccccttctagaatgtaaggtctatgttgagggtgaggactgcagttcaacactatacttccctaaacagtgccttgagtatggaaggcagtcaatttgctgaataaataacgaatgaatcctgatctggagaaaggaggaggagttgtgttacacaggaacattctactcaaggactgtgactaaggattgaaataatctgctagcaatagatgattagcataagcttcaaactagggctgggcgcggtggctcccgcctgtaatcccagcactgggaggccgaggtgggcggatcacttgaggccacgagttgaagaccagcctgggcaataaggcgaaaccccgtctctacaaaaattagcccggggtggtggtgcatgcctgtagtcccaggtactcaggaggctgtggtgggagaatcgcttgaacccgggaggcagaggttgcagggagccaagatcgcaacactgcactccagcctggatgacagagtgagaacttgtcttaaaaaaaagactgaaactaggctttaggcagttaactttttaataaagaatagtcattttatgtttggtgttgaatgttagctattgtaatataaaactctatttcttccctaaaaggggaaaagcaccgtaatgtacctattgttaatatactcttgtaacatgattattgaatattaaaatatcatcatagtagtactaaaaaattgttccctaagagttcaacattctcttgagtcctgaagttataaacttaagagtaatggggaacaaaattagtacttattatgtacgtagtgagttcacatcaccctaacagaaagttgagctattatccacattttacaaataagggactcgagactcctaagttaaaattaaaatctagccgttccctaatgctaattttcatcatgatatgtaaaagttataaccattggtttattttaaaagcctgagtacaataaaaaatccaaacgttctgagatgtctttgaatacattaatcaggactgagtactgcatctgtctttgcccctcctgaaaccaatacacaccttatctccatcgcattacctttgggaatgttatggcagtccctcttttcatcaatactacatagtcttccaaggctggcctcctcagcatgtactgcttaccgaaggaactcctcagtatctggccggggaacttccccacgatcttgccgaacgggactgccccccagttactatttaagagtccgaagttgttcaacctaaataatttcttaaattttgtttctccctccccagtctcagctaaaatcagttccccagcctgaaagggtctctctctggaagttgaacaagaaggggagacgtgacgctcttcgacctcggtagcggactgggcctgcgagagcatcgaaggatcctcggatccctggtgtgtgggaccgcaccggccctggtctccgctcgagtcctcgagctctcgaggggatgactcttcccgcagcgtcggcagtctgaggttttccagtgacgaaagacatccagtcccaatgtccgagatgctcagagggagagatgggcaagactctgctcctggggctttcctttgtgccgcctcgtgctctctttctccatctcgcaggtctctaggcgaggacctgcaacacagtgaccgagctccctcgaagggctcctgccccaggccgtgcaggaatgaattggttccgagcccctgccgcaggcacagcaagacaggaccgcggcaccatgccattagcatagtgtttcgcgaaggcgccgtcgcagacgagtgacgcaagcctagcgcgaccccttctttcccagtcgcgcgcatggcgcagcagcccgatggctctgcagctgcgtggggctctacagctccgcgactgcgcctgcgtcggggagggggcggtgcgctaggtcaagctagggcgcgggagcagcggagtcctggttgagtgaccatccaaggaatatgtcctcgcgcgcggccgccgttttccttttcggaatgtgggtaaagaatttaccgctaacagacgacctccaggttcgctcttggacagcaagattgagagacaaaacttaacaaagcgctgtgcaaactgaaatcccaggcttagctcgcttgtgtcttgaacacggaagtcacctagtcacccacaagatgtatgagtacagctaacccccagatgcatttgacagacggcgtgggacgcgccacttgctgattggctctcctttcccagttgaccgcgacatcccccagccccaactcccttttgatggggctgtgaccacctgccggtcccctcacccacccctcacgcccggagagtccgaggttgattcgagtactcactatgtgcttatgtaacacatgttttcattattaaaatataactagtttaccctcccaaaacgaaatagaagtgtcttaaaatggaaacaggtatctttggaggccagagttatttagcgttaaatatcactagcctcccagcattttgggaagccgaccgaggcaagcggctcatttgaggtcaggagttcgggaccagcctggcaaatgtggtgaaaccccgtctctactaaaaatacaaaaattagctgggcgtggaggcacgcacctgtaatcccagctactcgggaggctgaggcaggagaagcgcttgaacccgggaggcagacgttgcagtgagctgagatctcggcactgcactccagcctgggcgactgagcaaaactcctctcgggggaaaaaaattagtcgggcgcgatggtgcacgcctgtaataccagctacaagggaggctgaggcatgagaatagcttgaacccaggaggcggaggttgcagcgggccaagatcgagctaccactgcactccagcctgcgcgacacagcaaaactctgtctcaaaaaaaaaagaaaaatcgctagcctctttgctggatattagttgactgggcaaaagtttattgagagtctggcaatacgaggcacgttagacactcatttaagtttccaacaattctgtgttagaaacaaatccattttatgagtaaaagaactggcccagggagattaaataatttggggaaaccaggagtggtggctcacacctgtaaccccaacactttgggagacccaggccagaggattgcttgagcccaggatttcaagacccacgtgcaacataataataataagttggtcaagatgcatagctgacaagtggcattgcagagtttcctatttagtcagtctggttcagcagcccatgctctttgtactgtaacaccgtttggaaagactggtcaacagcacagttgaacttaaagtccaagtatattcaaagggctgtgaagtcaatgtgaattctgtttaaatttgatgaaataaatcttgttattctttttttttttttttatttgagacagagtcttgctcttgttgcccaggctggagtgcaatgacacgatcttggctcactgcaacctctgcctcctgggttcaagcgattctcctgcctcagcctcccgagtagctggggttacaggcacctgccaccatgccaggctaatttttgtatttttagtagagactcggtttcaccatgttggccaggctggtctcgaactcctgacctcatgatccacccgcctcggcctcccaaagtgctgggattacaggcatgagccaccgcgcctggccgttattactttctaagacataaattaatactttctaatcagtactttctaggacatcagccaccataaactccatcaacaggatttctcccttctttttttcctttttttttctttgtgagacagagtctcactctcgcccaggctggagtgcagttgtatgatctcggctcactgcaatgtctgcctcccaggttcaagcaattctcctgcctcagcctcccagatagctgggattacaggtgtgcaccaccatacccagctaatttttgtatttttagtagagacggggtttcgccatgttggccacgctggtttgaactcttgacctcaggtgatccacccacctcagtctcccaaagagctggaattacagccatgagccactgcacccagccaaatttctcccttctaattctaaaaatgaataaagaaactgctctctccacaccccaactgcgtgtctcactttgtgtagtttgctttttaggaaaagttatgaccaatagtttctggagtcgtaggcttttctcactactttttcttgtgataggctttctaagacaaaaactcatttttggttataaaattcttgaaattaaggagattatcattgccaaacatgggtctgagccggaacctcctgaactctaagccctatggtggttttaaaagttatcatacctactttattatttcttgagtattatcaaatgatacttggctgttatttcagaataagcaggaattggaaaaaaagaaaatacactaacaaaatatgggaagtaaatttacatatctttgatttttaaaacaaattgtaaatggaaaatggcatcactttctttccattgtttaaataacagccacaatgttatacgtattttgttttatacacatctaatgaaatacattagtacattttggaaaataatattatttattcatgatctttcagagcattgaaattcttaaaaaagaagtcactatgtgggcctttctatttctggctatcctttacttctgctttccctatgaaattgtcagcctgcactctgaaactattatcttgatgatgaatttgtgatacatcgtcaacttatcatgtttacttacttaatttatttactgagacggaactttgctcttgtcacccagtctggagtacaatagcacgatctcagctcactgcaacctctgcctcctgggttcaggtgattctcctgcctcagcctcctgagtagctaggattacaggcctgtgccaccacgcctggctaattttttgtatttttagtagagactgtgtttcaccatgttggccaggctggtcttgaactcttgacctcaggtgatccacccacctcggcctcccaaaatgctgggattacaggcgtaagctaccgcgcccagcccatgtttacattataaggctaagaaaaatactgttttctagtgacatttagttaagcatttactttaaaatctgaatagttctcaataaataccatggctgatggctggcattttaaaatctccaaacaggcaaccagttctagttccacaggtgatctcctccagctctttgcacatgcttcttcactctattttgtgtagttttcccttgtcctccagctatcaacctcacagtaccactggaatggtggctttgtaccaatcccaaaagacctagagtagtgcctttcacttctgctcccagtgggtcctgcctgtttttgtttttattttagaaatagggtcttgctctgtcacccagggtggagtgcagtggtgccatcatagcctactgcagcatcgaactcctgggctcaagcaattgccctgattcagcttccagcgtagctgggactacaggcatgtgccaccaatgcatggcaattttttttttttttttaaagacagagtcttgctcttgtcgcccaggctggagtgcaatggcgcaatctcagctcactgcaacctccccattctgggttcaagcgattctcctgcctcagcctcccaagtagctgggattacaggcacccaccaccatgcccagcaaatttttgtatttttagtagagatggggttttaccatgttggccaggctggtctcgaactcctgacttcaggtgatccacctgcctcagcctcccaaagtgctaggaatacatgcgtgagccaatgttttttgtttttttttgtttttttgttttgtttgtttgtttgttttgttttgttttgttttgttttgttttgttttacagggtttcactcccatcacccaggctggactgcagtagcattctcttgactcactacaaggtctgcctcccgggttcaagtgatcctcctgcctcagcctcccgagtaactgggattacaagctcatgccaccacccctggctaatttttctatttttagtagagacggggtttcaccatgttggcaggctggtcttaaactcctgacctcaagtgatccacctgccttggccttccaaagtgctgggattacaggtgtgagccacgcggttggccataatttaaaaaaaattttttgtagatgcagggtcttactatgttgaccagggcagtctcaattcctagcctcaagcaatcctccctcctcagcctcccaaaatgctggaattataggcaagagtcaccacatccagccagagtcctgtctttagatctatcatggcacatgtcatactatatggaaattgctatttatcatttcccaggatagaggatataattgttggggagaagactatgtcttgttcatcattataattccagtgcctggcacaaaacatctctcaataaacatttgttgaataaatgaatgaagaaagtagaaaatgagaaaattaacagcactgatacctagactactatactaaataactcaatgtataaacatggtgcaattatatttaatagttatcatgtattttgttctgtgtctgtacattcatttagtttttattagaactgttgaagttcacagatttttttcttactgtattttagcaaaatagaaaatatctatgtctaagactatacctgcttttctcctgctttttcactttatccccagttgctgctaaacttgaatctggattctgtagaacttctcctctaggatttactgctgtgttactagaaactgcaaatccaaattcagagaagtttaaaaccttctcaaacatgtgtacaggcatcaaagaaaaattgatgatattgagaattggagggtcttctcacttatcaccacccaccaccaccactcactaaaccccttttctgtttctaaattagaggatattatacaggatgaacccaagccagtttgttagcacattgtaagccatcattttagagtttcaagaattgatcagtccttcctcctcctggagaagatcttagatcctctttccttctcatcagggtccttcttttggagaatggactgactcctcacctccatcggccccagccctacctagtcagcgtcctgctcctgtctgggcttcagagaacctccacactgagtttctcctttccaccctccatctctttctcaggtgcaccaactcaccctcaataagtccgctggattttaaagttagctgtgagacgtttaagctttgtgtttatgttcgctgtctttgttcaccaagcttataatgaatgcacgtaaaataatcaactccactgccagtcacggtggctcacgcctgtaatcccagcactttgggaggccaaggtgggcgaatcacgaggtcaagagatcgagaccatcctggccaacatgatgaaaccctatctctactgaaaatacaaaaattagctgggcgtggtggcgtgcacctgtagtcccagctactcgggaggctgaggcaggagaattgcttgaacctgggaggcacaggttgcagtgagccgagattgcaccactgcgctccagcctggtgacagagcgagactccatcaaaaaaaaaaaaaaaaaaaaaaaaaatcaactcatctaaactttaagtcttaaaaccttggcagattcattcttcattcattcactcactttgcataattgactcctaatcatgcatatcttacaaccagaggacttatctggacacccaggaaaattctgttctaatccttcttctgtgtattgctgttttttgttttgtttagttttgcaaaattgtagtcatgccctttttctgttcttctcattctttactcttttcttgttcccattctttgtattatagattatgaatgagcataaacaacagtaaatgctttggctcacaccttagcaagaccatgtacaagtgtcaccatggtgagctctcctactacaagaagtcttgcctaattaagtggctcttgtttgtgctctgtaaagtcaagcagtttggtaagattgtgtattagttaagatacagtttagctgtaagtgaagtaggaaattctgggctaaagcgacactctgaagtatcattctacacttcatcctatgctatggtcattctgtagtgatcttatactcatgctatactacatcccagtcagtaagaaggggaaaaagaataaagtcataccgcctttaaaagtgtctctaaaaatgctcgtattacttctgcttacatttcactgaccagaacttaatcacatggccacatccagctgcaagggaagctgagaaattttgttacagctggacataagccagccaaaactgaaattctattattattgaagaaggggggaatggatttggggcaattagcattttatcttatgggtgcatgctagctagtttaggtaatcccccattgaacaaatatgttgtattccaaaaacttagttataaataggatctttgcaatctggtgtaaatagtggttacattcccaggtctgttcaaaaacctatttagggataaagtagctgaaacagtgttcatttttgaaaaagccaatagaaaattattaaaaagacacttgaatcttttaagcaaaaataaaatataaaatccatattttcgagtctgggcacaatggctcagcactttgagccataattccagcactttgggaggctgaggtgggaggattacttgaggccagaatccaagatcagcctaggcaacatagcaagacttcatctctataagaaatacaaaaattccattttttcgactctctgctagacaccaccaccatcattcagaatggatcagactggactaactcatcatttttacctctcctttgttttttccttcttccagttctctggaacccttgtccctggatagcccctatatcagtaaaaatcatatgattttctatcatttccaggctacaaagtttcaaatcacctgtgattcttttctttccacctctcttccaacccagacagatggacatatactcataccctctgatcagtggccagctcctgtggatttccttctcaggtcctctgtaggcacaatcatcttcctcatagactacaaagtctgactaccttggaacatgtgctgagaatctcctgtgtactatgcattgtgctaggctggggatacagagattggagagaggggcagggattaggtctttccctcaaagaactcacaatccgttagggaagatacaatggtataccaaggtcagagtggtgggagctgcctgcccaccattcaggccataaagaggtgcgctgtctgtgaagaattcaaaaacaacaatatagccaactacaagtcagtctgcttcttacaatcactgtgtgccaccaattgtaaacaatgtcagtgataaaatactctcctctaaaacttttagtattggcttaagttctaaacactgcactttgcttaatattatagagtttgaagtacgtatgtatgtatgtgcatttgtaacctatgcttcaaatgagcacatcctaattacttatcctttggtaaattttgtattctatatgaaagttaattctggctggacgcggtggctcacacctgtaatcccagcactttgggaggccaaggcaggtggatcacgaggtcaggagattgagaccatccaggccaatagagtcaaactaaaacacaaaaaattagcctggcgtggtggcatgcacctgtagtcccagctactcagtaggctgaggcggaggaatcacttgaacacaagaggtggaggttgcagtgagccaagatcgcaccactgcactccagcccggtgacagggcaagactctgtaaaaaaaaaaaaagaaaagaaaagaaaaaagaaaaaagaaaaagaaaagataagaaagttaattccaagaatttttaattatataactggccctgacactgtggatgcagttccaagagttctttttaagttcttaaagtttcagaatcatttgagcttgctatgggcacacttcatagtacccccgtggtactatatatgcctgtgttacaacaggagatttcaaataagcaataataacacatcaattataaagaagcagcagcagaatttgaagtactttcatcctgtcatactgtgacagtttgatgtttttatttgtgtttaaaatattttaaccatagagacatctgaaagttacctagacatctgaaagttactcaaagaaacaaacgcatggacagtattacaattactaaaatttattgagaaacgggatttgtatgaatctgacaaatttatctttaaaacttttcttaactatttgtatatatgttgtttaatgtaaaagaaattgttggccgggcacagtagctcatgcctgtaatcccagcactttgggaggctgggttcagggagaatcaggttcaagtgattctccagccttggccacccgagtagctgggattacaggcatgcaccatcacgcccagttaatttttgtattttcagtggagacaggatttcactatgttggccagactagtctcgaactcctgagctcaagtgatccacccgcctccgcctcccaaagtgctgggattacaggtgtgagccaccaagcctggcctaaattctctcacctcagcctcaccagtagctgggactacaggtacacaccactatgcccagcaaattaaaaaaaaagtattattattattttttatttttcctgagacagtctcactgcatcacccaggctggagtgcaatggcatgatctcggctcactgcaacctctgcctctcaggttcaagtgattctccagccttggccacctgagtagctgggattacaggcacccaccatcacgcccagttaatttttgtattttcagtggagacgggatttcactatgttcgccaggctagtctcaaactcctgacctcaagtgatccacccgcctccgcctcccaaagtgctgggattacaggtgtgagccaccaagcctggcctaaaaaaaatttttttttagagatggggcctcactatgtcactcagactggtcctgagctcctgggatcaagtgattctctttcctcagtctcccaaagtgctgggattacttccataagccaccacacctagccctggctaacttttatttatttttcttgtagagacaaggtctcactatgttgtaaaaatgttttaatgtaattaacaatattaacccactttttttttccttttttttgcgctatggtatctattattaatttatctattttaactggcagggcttcatatgtgaaattcaacaacagagaattaccagcgtatttttttcatgatgtttattgttatttgtttcatgttatgattattactaaaaatatttttattttatagagaaggaggatgattttaaaaagctgacccactcaggtgttgggtgtgctagctaccactggaatgattggctctggaacaggctcttttaatgcagtgtggggaatgaaatgatagcagtctacatagtgcggactcagacaaggattccctaagcaggtggggcttgagtgggggatcaagaaagactttcttgtaatttttatgttgatataatttctaaaggtgcacaaaggtctcccatacctgttttccaccttcaccaactttttacattttcatccctttgctctttctttccttttcctttttcttttcttttttctttcctttccttttcttttctttccttccttcctttctttctttccctttcttcctccctcccttccttccttccttcctccctccctccctccctccctccctccctcacttccttccttccttccttcctttctttttctttttttttttttgacagagttttgctcttgttgcccagactggagtgcaatggcgcaatctcggctcaccgcaacctccgtctcccgggttcaagagattctcctgcctcagcctcccgagtagctgggattacaggcatgcagcaccacgcccggctaattttttgtatttttagtagagacggggtttctctatgttgatcaggctgatcttgaactctcaacctcaggtgacccacccgcctcggcctcccaaagtgctgggattacaggcgtgagccaccgcgcctgaccccgtgtgctttttaattctttctctctcgctttctttctccctctccctctcccactctgtcttcctttcctccccatctttctctgtgcacataacacacacatgaacatttttttttcctgaaccatttgaaagtagattagagatatggcatccctttatccctaaatacttcagtgggtatatccgaagaacaagaacatgggccgggcgcggtggctcacgcctgtaatcccagcactttgggaggccgaggcaggcggatcacgaggtcaggagatcgagaccatcctggctaacacagtgaaaccccgtctttactaaaaatacaaaaaattagccaggcgaggtggcgggcgcctgtagtcccagctactctggaggctgagacaggaaaatggcgtgaaccccggggggcggagcctgcagtgagccgagatcgcgccactgcactccagcctgggcgacagtgagactgtcccaaaaaaaaaaaaaaaaaaaagaacaagaacatgttcccacctaaccacagtacagattatcacattaaggacatttaacattgttatcatactattgtctaatacagaacacattcaaattttgtcattttgcccaataatatcttccacagttttttccagcccagaatccaatccagattcacatatttcatttagttgtcatgtctctttagtcttcttttatctggaaaaaaacagctcctcagccttgctttatttttctgactttgatagttttgaagagtacacgtcagttgttccatagaattctccttgctttgggttgactgatgtttcttcctgattagatgtggattacacatttttagtagaaatatcactgaagcctcggtgtggtggctcacgcctgtaatcccaggacttcgggaggctaaggtgggtggatcacttgagctcaggagtttgagaccagcctgagcaacatggtgaaaccctgtgtctactagaaatacaaaacttagccaggtttagtggtgcgtgcctgtagttccagctacctggggagctgaggtgggaggaccattgagcccgggagtttgaggctatgctccagcctgggtgacagagtgagactctgtcttagtaagtaaataaataaacaaacaaacaaacataaaattactagtgaattgaagttttccttcataagacatcgtatcaggagtcatatgttgccggtttgtacctatattggtgatgttaactttgattgcttagttaagtcagattaattataatatcgccaccgtaaagttactattttaactttgtaaattaataaataatttatgggaagctacattgagactagttttacagtcactgatgactttttctgtatttattattagcactctactattaaaaaaactatcttaggaaaggttttcctgtttttgttaaacttcattgaggttaatttacatacaataaaatttaacaattgtaagctaaattttaataaaatttggaaatatttagtaagcaaacaatccagtgatttttagtaatttaataaaattgtgcaatcattaccataaaccaactttatgttattatttttatttttatttttatttttgagacggagtctcgctctgtcgcccaggctggagtgcagtggcgccatctcggctcactgcaagctccgcctcctgggttcacgccattctcctgcctcagcttcctgagtagctgggactacaggcacccgccaccacacccagctaatttttttgtatttttagtagagacggggtttcactgtgttagccaggatggccttgatctcctgacctcgtgatccactggcctcggcctcccaaagtgctgggattacaggcgtgagccaccgcacccggcctatttttaatttttttgagacagagtctccctctgtcctccaggctgcagggcatggcatgatcataactcactgcagccttgagcccctgggcttaagggatccttctgcctcagcctcttgagcagctcggactacaggagtgtgccaccacacatggctaattttttattttttgtagagatagggtctcactacattacccaggctggtctcaaattcctggcctcaagtgatcctcctgccttggcctcttaaagtattgggcttacaggcttgagccaccccagctggccacagtccagctttagaacattctatcggctgtgtgcggtggctcacaagtgtaatcccagcactttgggaggccgaggcaggtggatcacctgaggtcaggagttcaagaccagcttggccaacacagtgaaaccctgtctctactaaaaacacaaaaattagccaggtgtggtggtgggcgcctgtaatcccagctactcaggaggctgaggcaggcgaatcgcttgaacctgggaggcggaggttgcagtgagccaagattgccgcattgcactccagcctgggcaacagagcaagagtccgtctcaaaaaaaaacaaaacacatttctgtcatcctaaaaagcgccctcatgcctgtttacacttcatctccattcccatccagccccaggcaattactcacctgttttctacctctagaaatatgccttttctgaacatttcatataaatagcattgtacaatatgtagttgttttgtatctaacttcttttacttagcataagattcttgagctatatccatgttgtagcatatatcaatacttcatttttattgctgaataattttttttttgagacagagtcttgctgtgttgcctaggctggagtgcagtggcaccatctcggctcagtgtagcctccgcctcttgggttcaagcttttctcatgcctcagtctccctagcagctgggattacaggcgtgcaccaccacacccagctaatttttgtatttttagtagaaatgggttttcacgatgttggccaggctggtctcgaacccctgacctcaggtgatctgtgcgccttggcctcccaaagtgctgggattacaggcttgagccaccgcgcccagcctattgctgaataatattttattgtttggatatatcatattttgtttatccattcactagttgatagacatttgggttgttgacggttttttttttttttttgagacggagtcttgctctgttgcccaggctggagtgcagtggtgcgatctcggctcactgcaagctctgtctcctgggttcatgccattctcctgcctcagcctcccgagtagctgggactacaggcacctgccaccgcgcccagctaatttgttgtatttttagtagagatggggtttcaccttgttagccaggatggtcttgatctcctgaccttgtgatccgcccgcctcggcctcccaaagtgctgggattacaggcatgagccaccgtgcccggccgctgatggttttttactacacaaataatcctcctgtgaacatttatgtacaagtttttgtatggacatatgttttcatttctctcgggtagatacttagaagcagaattgctgggttgtatgggaaattcatgttacatttttaaaaagaaactaccaaagtattctccaagaggctgtaccttttcatatttccccaagcaatagacaatggttccagtttctttacatcctcaccaacacttattgttgtcatctgtctttttaattatagccatattagtagtgggcatgaaattgtatctcattaatgttttcacttgcatttcctcaatggctaattatgttgagcatgttttcatgtgcttattaactattcatatatctttggtgatatgtctattcgagtcttttgctgatttttaaactggttgtttactttcttgtttatatattctttgcatgtggatatcaattagcccactaccatttattaaaaagactattcttggctgggcgtggtggctcacacctgtaatcccagcactttgggaggccgaggcgggtgaatcacctgaagtcaggagttcgagatcagcctggccaacatggtgaaaccccatctctactaaaaatacaaaaatttagctgggtgtggtggggcatgcctgtaatcccagctgctctggaggctgaggcaggagaatcgcttgaacccaggaggtagaggttgcagtgagctgagattgcaccccagcctgggtgacagagtaagactctgttaaaaaaaaaaaaaaaaagcaggtcaggatctggaatatgatgtttgaggcaatccatagtgagcgatgctggggaggttggcagggaccagattatagatagttttgtaatccgtatgtattaagcggtatagattttttcctgtacatgccagcaaggttgggaagaaagggcttaaagtagagagagatggcatggttacatttatggttttcaaagatcatacctaggtaccagcctggaggaagagagtccaattaaaagcagtagtggcagcttaggtttgagatgtaaaggctcaaataagaacagaggtgatagaattggatggaggtaaggagattgaatgaggaattatttaaaagataaaatagaatctgatgatttatccaatgtgtgtatgtgtttgggtagaagtgagatgtggggctggggaataaacaggacggactcctggctttctacagtgctaactggacagatggtggtagcatcaactgactcaaagaatacaaaagaatgagcagaattaagttcagctgtacaacctaatctatagtacttggagaagaaagtccattttctctcatctaaaagaagtgcaggcacggtggctcacacctgtaattccagcatgttgggaggccgaagcagaggattgcttgagcccaggatttccagaccagcctgggcataatagtgagaacccctcgccaacacacacacacacacaatatccctacaaaaaataaaaaattagccaggtgtggtggtaacatctgtagtttcagctactcaggaggttgaggtgggtggattgcttgagtcaaggagattgagactgcagtgagccatgatcacgccagtacactacaacctgggcaacagagtgagaccctatctcaaaaaacaaaaaacaaaaacaaaaaagtccaaaggacttggtccacggcacatgtaatgcttctgggtttctaggtccttcagtcttgtggctctgccattctcagcgtgttattttctcctcaaagcccaatatggatgttccagtcctggctatcacatttgagttccagggattaataatgaaaaagtagtgaagaatagcatatggtctcattttaagaatattgttctacaggcccatctcacatgggctcaccttatttcaaagaaggctggacaggctgggtgtggtagctcacacctgcaatcccagcacattgggaggctgaggagggtcgatgacttgaggtcaggagttcaagaccagcctggccaacatggtgaaaccccatctatacaaaaaatacaaacattagctgggcatggtggcacgcacctgtaattccagctactcaggaggctgaggcaggagaattgcttgaacctgggaggaggaggttgcagtgagccgagattgcacccttgcactccagcctgggcgacaagagcaaaactctgtctcaaaaaaaagaaagaaaaaagaatgctggacaatgtagtctttgttatggaaaggtttatgcccaggtaaaaatggaaggttccttaatgtagtagagaaatttagggataaatggaatttagggtacaattagtagcctctgcaacaagatattttagagggaattatggggacttccactgggacttgtgcttaagctgctcatggtgaattgtccatgtgcaaatgccttgcaggtagttggatatgtgactccttttcctaaagtgcaattctcataaattgacttgtctgccccaaactttcaatgactttttactccttacactggcattgagcaccaggctacacttcctttcaaggtactagctgacaaaatcaccccctattctttgaatgtgccccatacttttctgtttgcgtgcctttgctcttctagtaccttctgcctggaatgccctttcgagaactcttgttcataccttataagtctatctcactggatcctcaaaaactgaatcagttgttaccatcttctaaattcctctaaaaatttgcatacacttctgtgcttatcatcttctgctttgtacctaaaaagcactcaacagggcctggtgcagt

SEQ ID NO: 2 - DNA, 186647 bp, Homo sapiens
gaattcatttttattgttgttgtctttatacctctttgaaatattttcctaaatatcttttgccttttcattctcccactttgctaagtaaagattatttggttgtaagaaacaaaaattggggcagttgaagcaaaacaagtgtaattacaatttcaaagaattgtcagggtacacagagacagcttgtctgcagggagggattacaggagacagaatcattagggcttttgtgtagtccctttttttttgagtcttgcactgttgcccaggctggagtgcaatggcacgatctcggctcactgcaacctccacctcccaggttcaagcgattctcctgcctcagcctcccgagtagctgggattacaggcgcccgctaccacaccgggctaattttttgtatttttagtagagacggggtttcactatgttggctaggctggtctcgaactcttgaccttgtgatccacccgcctctgcctcccaaagtgctgtgtggtctcttaactgctgccttggagttcgtgctgttgtttggctgcctgactgttcctgaggttatgatgttatcatccagccacttgctgattcttaggagagctgggcattctctgctcccttagatccagccctctccccacacctttctccatctgctccatgcctttggaggctgagtaccaccgatggcatcagctcaactcccttgctggagattggagtgtgggaggccacacggtcagagtctacattcccctgctgaactctgcagggctatggtttggtggggtcctccctggtcatctggttgtgcccttcactctggctggaagtctagtgacaatttcctcctgttggtcgctttccgcctgtcccagaatgcctcactcttcctcgtaggctcccttaactccactcacaccgttttaagtactgtagtccctttataaaaaatctcttagccctgcttaacagtgtttgtttcttgctgggaacctgagccagtccgtactcccacttcctgggaggaacatctgattggctgcattttggttcaggtgttcatcctagcccaatcacccctgcctgggctggggtcacactgccaggagccttgtgaagagggcagttttcatgctagaagtctggttcattgggaactgagctggacagatagctgttaacatttaaaaaacacacatttttattttttaatgttgtaaaatataaaatctaccattttaaccatttaaaaaaagtacgcagttcagtggcagtgagcacattcacgctgtgtatcaccaccatccatctccagaactttctcatcctcccacactgaaactctgtatccattaaacagtaaactctccctccagcccccggtaaccaccattcttctttcctgctctatgactgactattctaggaagctcattaaaaaatgcatattaattagacaagtattatagaaatacattcttgtaaaaaagatggaaacatgacacctaaggctagactaactgcccgtcacctggcttagtgattacgtgcagaggctaccattgttactttagagttttggactccaaatcatttctgtgaatctgtgatttctgtgaatctacatacagatgtgctctcagaaaataagtgatttcttttcccccacataaatggtatactgtatgcagcattctgcaacttgagcttgcttttttttttaaacccaatatattttggaggactttccaaattaataacataggactacgttcattttaactgcagcaggatcagagggagggctggttaaaacacaggctgctttgccctaccctggagtttctcattcagccagatgggggccaaagaatgcgtcccacgtgatgctgctgctgctgctgtgttacggctgcgcttcggagaaccactgctgccattccctgatcgatagatgcttggggtgcttcctgtttctcagtaaagtgaagttgcggcgacctcgtgcctgccttatgtgcacctgtgccagcatctttctcaggtgggtaaggagaggtggaattctggtcacaggctacatgtaccttaaatttcaatagattccgtcaaattgcctctcagtatggctgtaacaatttatagatgagcttccacacaatattttacccaagttaaaaataaatcctggccgggtatggtggctcatgcctgtaatcccaacactttgggaggccgaggcgggcggatcacctgaggtcaggagttcgagactagcctagccaacatggcgaacccctgtctctactaaaagtacaaaaattggccgggaatggtggagggcatctgtaatcccaggagaattgcttgaatccgggaggcggaggttgcagtgagccgagatcgcgccactacactccagcctgggccacaagagggagactttgtctcaaaaaacaaaaaacaaaaaacgaaaaacaaatcctatgggaattttgattgggcttgtgataagccaataggttaatttacaattgatttctttttgtttgtttgtttgagatggagttttgctcttgttgcccagtatggagtgtagtggcgtgatttcggctcactgcaactttcttctcccggattcaagcaattctcctgtagccgggattacaggcgcccgccaccacgcctggctcatttttgtatttttagtagagacggggtttcgccatgttggccaggctagtctccaactcctgacctcaggtgatccgcctgcctcgacctcccaaagtgctggaattacaggcataagccactgcgcctggccaagaattgatttcattacggaatattataacattaaaatgtacctttctcacatgatagtaatacaatgatgatgattttttaaaattgggaaattgtggctcttctccctctggctggagtcatgacgctggaagaaatgatctcattgctcctttaggagtgtgtatatctgaacattccagtttgggcaacattgataaggtttgttcacatgatacttaccacactcttacctcatgaatgaatgattttgtgtgtttatttcgaacttcagtttcataggatagggaaggagtagggggtctacaagggtggggagggtatcttcaataggagaggtgtttttttgtttttgtttttttgccactctctcacagctgggtgttcagggccctgcatttgacacagtgttgaatgtccctaggagggggactatggcatagggatgagtagggagacacagttgagcaactaattaggatgtgaggtagaatgagtcattaactttcaccagtgaagccattacagtcatgacaaaaaagaaattgatctattaagagccagggatttaaatgattttaggatttgagggagggccttctaggaagcaagagtgatgaaagtgaaagacaaataggtccgttctagaaatttgcaacttgagcattttagaactgaggtccttgattggttggaaatcaggtgtaagagattatctagtggtaagcaaccaaaatgagtttgaatgagtggagagcgtatggcaaattcttttcaggtgtctccaaatgatcctttctccctcactagaccttgttttttttttttttccttttcttttgggacagggtcttgccctgtttttcaggctggagtgcagtggcatgatcatggctcactgcagcctcggactcccaggctcaagtgatcctcctgcttcagcctcccgagtagctgggactatgggcatgcaccaccatgcctggctagtttttaaattttttgtagagttggggtcttgctaagttgcccagattttgaactcctgggcttaagcaatcctccctccttggcctccccaaatgctgggattacaggcgtgagccactacagcgggctgacattccatttttggattttggagtgcacacgtgtgtattggctttttgctgttccttggatttggtgaattcaggggaagcacgaccaggttgctacaattgtattttttctcatcttcaccaggcttgtcgggattgtccaggttactttctctggttagaagtataatacaaacgtcaatataaaaagcatccactaggtgccagtcttgctttgtgcaaatttctttttatcccagccttctgggagagcagttggttctggccgcctcctgtctaaactcccgtggagggtggggatgtgagctttctgcgcgccagccctctgggattggctgagagaatctccaaagtgcttgcagctcttttctggtgtccaagtcctgaagcggaacctgaatgactgtagcccagcagcaggcgtgatgagaggggcctggagggaatcctgatgggaggagatcgagtctccaggtggtggctgcacctccagtttccctggcctggctgtaccctccctggacctgaccaaactccccaccgggctacagatgctaacccgaaaaagtgcccagctgtcaagagaagctgcagcagctctttagtctgacacagttgctgagcataggaagcttgaattgatgtttccccctcatgtccttaaatagtgaagtaatagccaaaataagaaagaaattaaccacatcatacaccaactgcatcaatttccccatagactttgtccatgaaatccaggagtttacatatgtcaatgatagtggggaagagggagaagaatatggtttttcacttcttttcccaacttaggaaaatttcaaatatacagaaaagttaaaagaatagtataggccgggtgcggtggctcatgcctgtaatcccagcactttggaaggccgaggggggcggatcacaaggtcaggaaatcatgaccatcctggctaacatgctgaaaccccatctctactaaaaatacaaaaaattagccgggcgtagtggcgggcgcctgtagtcccagctactcaggaggctgaggcagtgaacctgggaggcggagcttgcagtgagctgagatcgtgccactgcactccagcctgggcgacagagtgagactctggctcaaaaaaaagaaaaaaaagaatagtatgatgatctgtatatacacgccacttaaagtaaaacactgttgatatagtcatatgacccttaacaacggggatatgttctgaaagatgttgttaggtgaaattgtgtcattgtgagaatcaaagagtgcactgacataaacctgggcggcacagcccgctacacatgtgggctatcttatgtagcctacattgtttctaggctacaaacctggacagcatgttcctggactgagtactgtaggcagttggaacacagagagatgtgtgtatctaaacatagaaaaagccaagtaatacgctattgtattataatcttatgggaccaccgttgtatatgtggtccaacattgaccaaaatgtcattatgcagtccatgactatatttggctatatttttcttcatctgtatttgtgtgcatatatttatttttgctgatctactagaaagtaaactgaaggcatcatcacactttattcttaactacttcagggtgacgtgcctacagattatgactcctgcaataactacaataccattcttatatctctgaagctccaaaccgtaatcccctaataccatcctcctgtctaattatttaatattatttaatttttaattttttttgaggcagaatcttgctcactctgtcacccaggctggagtgtagcagcagcacgttaatattcagtttcttttcaaatcaggatccaatccacactcactcactgggtttgtttgtcaagtcttctttagttacttttgctctaaaacggtctcttaccctcttgcccccttagttttatctgtaacaatcacacaccgaggagaccaggccagttgtcttgcagaatgagccacatgctggattagatcatttccctaagtgagtttaactcattcctgtaccctctgtattttctatcatctggaagttgtacctcggaactacccagtacaactttctgtgatgacagaaatgttctctgtgctgtccaaaatggaagtcattcaccgcaggtggccagtgagcacctaacatgtatccatgtggctgagtgacagaattgttaattttatgtcattctcactaatttacgtttaaatagccacatgtagctagtggctatggtctgaaacagcacaggtcttaagcttgattcgatttgacaagacatcaaaggtgatgctgtatacttcataccggaacacaccaagaggcaagataatgacaaagtctttctttttcttttttttggtttgagtatgatgtttagtataagatagagtggcttggcagagttggtgcaaaactgaagagaaccagattcagttctagtcagtgagttagcagcctagggtcaaaaaaattgaccctgctgtcctgagtcctctgaggccctctgcacatcaccagctagaagctccgagactgatatgccactgcttggaggcttgggtagaatccaagtgtcctcagtttccagagtgacaagagactggccccagccatcagagcagtagacaaaggcttttgtttaaaaaaagctttgaggtataatttattatttaatttttaatttttttggaggcagaatctttctcactctgccacccaggctggagtgtagtaacgcaaactcggctcacagcaacctccgcctcctagattcaagcgattctcccacctcagcctcccaagtacctgggattataggcgcccgccaccatgcccggctaatttttgtattttagtagagatggggttttaccatgttggccaggctggtctcgaactcctgatctcaagtgatctgcccgccttggcctcccaaagtgctgggattacaggcatgagccactgcacccggcatgaggtgtaatttataatcaataacaatattttaagtgtaaaggtcaatgagtttcaacaaatgtctacacctgtatagtcacaacacaatccagatacagaagatttctgttatcccaaagattcccttgtgcagcttcccaattaatcccaaatgtccctcttttccacaagtctgaggaaaccagtgatatactttctatcattatggaataagtgtctttgcttcagcttcatataaataacatcatacaaagatactctttgttttttctccaactacaattactttaagtctctgaaacaatatttccttacaacttaagtagtttttacagtagtgacatttatcattgatgggatttgcttgtttaatatgactatagtcagaagggaagttgggcctattattcttccagaaattaaaaaaaatcatcattaaggaagagaaagatttatatcatctttttgggacacgtaagtctcacagttggagaatttgcggatattgctatatacactatatatacatacatagtttttttttttttttgagacagagtctcgctctgtcacccaggctggagtgcactgtcatgatctcggctcactgtaacctccatctcccgggttcaagcaattctcctgcctcagcctcccaagtagctcagattacaggcatgtgccaccatgcccagctaatttttgtatgtttggtagagacggagtttcagcatgttggcgaggctggtctcaaactcctgacctcataatgcacccaccttgggctcccaaagttctgggattataggcgtgaaccaccgtgcccagcctacatatttactcgtgattctggttttccaatgacggatcctccatgtttttgagattgattgatgttgcatgtgtctgtagtttgtccttattgccaagtggtatgtgttggtatggatatgccacaagttgtttatcccttctgctggtggagatctgcattgtttccagtttagcattaaaaggtagactttccctctatacactgctttagttgcaccccataaattttgattccctctccctctgcctctctgtctccctttcccttcccttccctcccctccccttccctcccctccccttccctcccttttcctccccttccctccccttccctccttccctcctttcctccctcccatcctccctcccttccttttctctgtctccagggtctcactccattgcccagacagctctctgaagcccggatctcctgggctcaagtgatcctcccaccttagcctcctgagtagctgagactacaggtgtaagccaccacacctggctaatttttaaattttgttttttgtagagttggggtctccctatgttgcccaggctagtcttgaactcctgggctcacgtgatcttcccacctcagcctctgaaaatgctgagttacaggcatgagcccctagcctgtggtgttttcattttaagaattcagttcttagtattatttaatttttcctcctcttgtttttctcctttgactcctggattatttaaaagtgtgattttaagtttccaaatatatgaggattttccaaagatctttttgatatttctgattaattttgttctaagagaacatattttataggatttaatcctttatatttattgagatttgttttatgactcagtgtatgatctatcttggcaaatgtttttgtttttcttccgttttagagatgaggtcttgctctgtcaacccaggctagactgcagtggtgccgtcagagttcactgcagcctccaacttctagtctcaaatgatcctcctgcctcagcttcccaagtagctaggactacaggcatatgccaccacacctggctaacttttaatgtttttttgtagagatgaggtcttgcttatttgcccaggctggtcttgaactactggcttcaagtgatcctcctgtcctcccgccttggcttcccaacatgctgggatgacagccaaggcatgcagtgcacctagctggtgaaggtttcttatgtacttgaaaagaatgtgtacctggccgaatgcggtggctcatgcctgtaatcccagcagtttgggaggccgaggtgagcggatcacctgaggtcaagagttcaagaccagcctggccaacatggtgaaaacttgtctctactaaaaatacaaaaattagctgggcatggtagtgtgcgcctgtagtccaagctgcttggaggttgagaaaggagaattgcttgaacccaggaggtggaggttgcagtaagccaagatcgcgccattgcactccagcctgggtgacagagcaaaaactccatctaaaaagagaagaatgtgtatctgctattgttgggtgcaatggtctgtaaatatcaatggaatcaaattgcttgatagtgtcatgcaggttttctactttttgtatctacttctcccattaattactgaaataggcctattaaagtattcaaatctcaatatacatttgtctgtttttccttcaattctgccagttcttgctgcatgtatgttatgctttgttatggtatattcacatttaagactgttacatcttcttgatgaattgacccttttgacattatgaaatgtccatctttataccagggaacgcttcttgttctaatgtctactttgtctaatgtagccactctggtttttcaagtggcttcttatttgtatgatgtatctcttttttttcctctttatctgtgtttttaatttcaaagtgtttttcttgtaaatagcacctaattgggtcttgtttttttttttttttaattttaatttttagttctgggttacatctggaggatgtgcaggtttgttacataggtaaacgtgtgccacggtggtttgctgcccagatcaacccatcacctagatattaagcccagaatgcattagctatttttcctaaagctctccctccccccacccaaccccccagcaggccccttccatgtgttgttcccttccctgtgtccatgtgttctcattgttcacctcccacttataagtgagaacatgtggtggttggttttctgttcctgcattggtttgctgaggataatggcttctggcttcatccatttccctgcaaagaacattatctcattcctttttatggctgcatagtattccatggtgtatgtgtaccaccttttctttatccagtctatcacggatgggcatttgggttgattccatgtctttgctattgtgaatagtgctgcaatgaacatatgcgtgtatgtatctttataatagaatgatttatattcctttgggtatatacccagtaatgggattgctgggtccaatggtatttccggttctagatctttgaggaatccccacaccctcttccacaatggttgaactaatttacattcccaccgacagtgtaaaagctttcctatttctccacaacctcaccagcgtctgttgtttcttgactttttaatatttgctgttctgactggtggggttttgtttttttatccaattgaactcttcctgttaattggaatgtttagagtattttcatgtagtttagttaccagtttgattgggattaagtgtgccactctgctatttcttttctattcgtctcatctgtttttattgcccttttcccccttcttctcatgacttttggattgaataattttaaaatttcactgcatcttcactattggcttgttgttagccctgctcctttgtattgttgttttagtgatggctctggggtttatcatgtgcgtcgccatgtgcatggcctttcccgttccctagtgagggccccaagttatcaacagggatccgtctttctgaatagttgggactcagatgccgtgtaagccctgggaaccctttagctcactgcttctcagcagctctttgcctggcttcctggaattgtaccctcttgtgcacatcttagtgtggagtaaagactcaagaggactcccatgcagacttttggtgttttttaagcaaaggctttctgcctacctccctcttctctaagagctctgccgtatgacttccactgcctcaactgttctggattccaatatctgtctcctcagtaccactagattgggatgccccttccctgcttcatggtctagaatgcctgattcctggaggccttgcttcctctgttacccttctcttaggaattgcagggctgcctgtagtccagtgtctgaaaataattgtttcacactttgtccagttttctcattgtttcttctgagagggtatttggtccatgttattccatcatgtcagaaacagagggctcacttagcttatttttttttttttgagacagagtctccctctgcctcccaggctggagtgcagtggcacgatttttggctcaatgcaacctttgcctcccaagtagctgggattacaggtgtgcgccaccacgcctggctagtttttgtatttttattagagacagggtttcaccatgttggccaggctggtctcaaactcctgacctcaggtgatccgcctgccttggtgtcccaaggtgccaggattacaggcgtgagcttatttaatttttttcctttttatttatttatttatttttgagatggagtctcgctctgtcaccaggctggagttcagtggtgtgatctcagctcactgcaatctccacctccggcgttcaagcgattctcctgcctcagcctcctgagtagctgggactacaggcgcacaccaccatggccagctaatttttgtatttttagtagagatggggtttcaccatgttggccaggatggtcttgatctcctgacttcatgatctgcccacctcagcctcccaaagtgctgggattacaggtgtgagccaccgtgcctggccaaattattgtaataatttaagaatgtatataaataatccatgtttacagtagaaaatcttgaaataacaattgcagcaagaattacccacaattccctgcatcccaatgtaggcaaaattaatgttttagcatatatccttccagacctttttaatgtgtatatgtatctataaatataaaaataagaccatatcatctgcaccacatgatggtttataatggctgcctactccccaagagcacaggagaaatggcacccatttttcatgtgtattatgacagctcatgagtttcataggaaagcctactgcatttcagagatgtttgtaagactctggacttgagaaatttcatatgtaaaagaaagccatataggttttattttttaaagtctgcaagtctgcaaatgtaaaaagtttcaagaggaagaattttatttcattagaaaaaaggaaagcggcagcttttacattacatttttaggctcccaaggtgctcaacatcaaatgcattgtacaagtgaatgggcataaatagataacatttccaaaatagatgatcagatttcaagaaatttgccaaagtctagactttattaatttggatcttgtaaaaattaaaaaaaccctgcactttgggaggccaaaacaggaggatttcttgagcccaggagtttgagaccaacctgggcaacatagtgagaccttgtctctacaaataataaaaaaaatagccatgcatggtggagtgcacctgtggtcccagctactcaggaagatgaggtgggaggatcccttgagcccaggcacttgaggctgtagtgagctgtgatcgcaccactgcactcctgcctgggtgacagagagagatcctgtctcaaaaaacaaaacaacaagaacaaaacaaaatcaaacaggccactctgcttaaaaaatgtagaaattaaagctctggaactcttatcatgaaatgtcctccactggccctagctgaggtggccatgggctgacctagcgtgacttttcctataaagaaattaagtattgaaaaagcactgattagaggggtgaggatccagtttccagcgcttactccgtgacctttggcaaactgcttaccttccacgagtgtcaatttcctcatctacaaagcaaagataagagcaattcaaagggtgagcatgaagatgaaataagatggtctttttttttttttttttttttttttagatggagtcttgctctgtcgctctattgcccaggctggagtgcagtggctcaatgtcggctcactgacactgcaacctccccctcctgggttcaagcgattctcctgtctcagcctcccgggtagctgggattaaaggcatatgccaccacacctggctaatttttgtgtttttagtagagacagggttttgtcatgttggccaggctggtcttgaactcctgacgtcaggtgatccgcccgccttggcctccaaaagtgttgggattataagcctgagccaccacgctgggccaataagatggtctttaatgtgtctggggacaaggaccctcaggtgttcagtaaaaaaatctcagcaatgttacaaaactagcttaaatagagtcaatagagcgataggtataaaatcacaccttccatttattcccattatctttatttcttttccagctaggtcttctctttttaatggttaaattattattgtttttataacacagcaaattctacatttggccaccttggtttctagattcatgggtatgttctgctctcatattctctctctcccctcttccctcctcgctccctctctccctgcccttctccactccccgcagcggaggttgtccatttcctcagtgtgtctgttggttgcaatgaggccatcttggtcctttacacctttgtccttttcctcgcacccatatgcaccctaggaaaagtgtgcatgactttgggaggccaaggtgggtggattgcatgagtccaggagatcgagaccagcctgggcaacatggcaaaactccgtctctattgaaaatacaaaaaatacaaaaaatattagctgagcatggtggcatgtgcctgtagtcccagctacttaggaggctgaggtaggaggatcactgagcccagcaggtggagattacagtgattggagattgcatcactgcactccagccagggtgacagagtgagactctgtcaaaaaaaaaaaaaaaaaaaaaaaaacaaggaaaaagaaaaaagcgcatgccgaacgtgcttctgagtgaagtactcccctgtattacccttaaagggtccttaaagagccattgcctctgctgtgatcgctgtcagtatttcagaagctggctctctctgcatctaggatgaatgaggccattggtgcaggcagtctgagtgccaggaagatcagcatgagaggaagacaggatatttctctttggtctcaccagaagaatatgccatccattattcacagagagaaggacaaaggtccacatgtattttaggatggagcaccgtgataggccgtgcagagaggtttcgggaggattctagctgggcgtcaggagatttgcaaggtttgcagtgcaggccatctctgggggattgaaatttgccatggaggttttcagttctggttttagccacattgaaatgtgagattattagggtctgagaggtcaagggctttgcccaaggccacacagcatttgtagctgcctggcagaatgtggggcagcagtcgtgagtgctacagtggagtcagaggcagggggctttggtcccgggtgggcagctttcccaaatgcagaagttggaagctacactggcagaacaaatgaggattccagaagacaggaggcccaatgggacttgggtcactcacaccaatgggtcattaacttttgtacctatgacatcttggagtacaagaagaaaaacaaaaacgcccaaacaaaaagtttggcaccagacagacctctgttggaatctagactccagcttcctgactacaaggcctctgacaaggtctttgaccttggaatgagagagaagtttcagaaagccaccttggaatgagagataactcttataagtaacaatgtaactgctctgacacacaatagatgcctaatgaatgttaattttctttctttttatcttcccttccctaaatttcggttgtcttcctttttttttttttttttgagacggagtttcgctcttattgcccaggctggggtgcaatggcacaatctcagctcaccacaacctctgcatcccgggttcaagcaatgctcccgcctgagcctcccaagtagctgagattacaggtgcacaccaccacgcccggctaatttttgtatttttagtagagatggggtttcaccatgttggtcaggctggtctcgaactcttgacctcgtgatccgcccgccttggcctcccaaagtgctaggattacaggcatgagccaccgtgcccgacatcggttgtcttgtatacaattcttacaaaagtcctaggacataggcaggaacaatatttttcccctatttttgagatgagaaaatgggtttcagagaagtttaatgatttgcatgaggccccagggacagagctgggtctgcatcccagaagtcttgagaatagagtagagctgctacagaattagataagctgggttttaatccttttgtgaccactgctagttgagtgacctctctgagcctcagtttcctcatctataaagtggggataataagagtacctatccaaaggattgttttgaagataaatgatctaatatataaagcgcttagactggcaaataataagtggtagctctgattgttaaatgagccattaggatcctggcctgctctctggggcttgtctttgaacattttctttgggtattctagggaatgtctttcagagttctgggtgtcctgcctattaatgtggggaaatcactatccacctatatcaagttgcttctccctggcggtgagggccatggggctgtgtgtgcaccctgttaaaagcccagggtggactcccaggagcaacgcacccacctgcgcccactctattggctgacctgagcttgctgtcaaactctgtccccatgcatgtctctgtctgactgtggctccgagggagtgcactctttctattcatttggctactgacagataccaaaaattgatttatatccatggtaactgtcacccaggggaactgtgaaaaacaagaaatcttttcttccattcacatcaaacagagccagtgcccagagacctctgggcctggctttcactccggctggccctggctcatctccttgaggaggaagtgtgtgtcctctcctgcacgcctctccttcctggggagccctggctcacagctggagccagcaggcctggaggctgcagaccctggactgggacttgttgcttttgagagctcccctgaagcctggctcctcaggtatggagtgggaatctctggaaagtatttgtcaatcacattccagaggggggttgaaactgctcacaaacgcttgtgtttggtgggagtttagtttcttttcttttttttttatgagtcagggtcttgctctgttgcccaggctagagtgcagtggtatgatcacagctcactgcagcctcaacctcccaggctcaagcgatcctcccacctcagctttcggagtagctgggtctacaggtgtgcgccatcatgcctgactaatttttagattttttgtagagatggggtctccccgtgttgcccaggctgttctcgaactccccagctcaagcaatcctcctgcctcggcctcccaaagtgctgggattataggcgtgggtcaccacgaccagccggtaatgtatagtctctagagaaaggattggtgggggtgtgggagggatcctcaatcaggttttttgaggtgggaagccacgttctcttgcttctgactcctgaggctggttttgtttcttctctgagatattttttcctgagtggtttttcttcctttttcgttctgatggcttttctgaagggcagtcatgaggatgtgcctgtaccagctggggagagagatctacaccttacctggcttggacaactttcttgaggtctgatttttcttgatggttctaaggagtaaaatattatttgaatcgaatgataaatttgttatttgactgtgctcaagttctgggctagttgctttggaaactttgaaacagattatagcagagttttgcaatgtctgttcttgaaaactctgatcttaagagatattttatgaaccaacaggtctatatggtcatatagatttggaaattgcttcatactctatcccttattggaacgtcgtaatacacagtgtatattaaaggccctgagacatgggataggtaagaaatgagttcagtattatttatttatttattcacattttattttttgagacagggtctcactctgtcgcccaagctggagtgcagtggtgtgatctcagctcactgcaacctctgcctcctgggctcaagcgattctcctgcctcagcctcctgagtaactgggattataggcacgtgccagcacgcgtggctaatttttttgatgttagtagagatggggtttcaccatgttgcctagggtggttttgctctttcgtcactgaactcctgagctcaggcaatctgcccaccttggcctttcaaagtgctgggattacaggtgtgagccactgccccgggtcagtattatttatttagactagtcaagtggagtagtgagaagagaggaaagaggaggacgagttttatgtgtaactgactctgttataatggagataactcatcaccttcagacgcagcctcagcattatttaagtccatgtttcccaaacttcccttaccatagaatatttttttcttctttgttctgtatttctttccacagtcttcatttgttccacaaaacacacttggagaatggctgggctggagattcccactggctctggggcaagtctggccaaaggcatgattccagaccacagctggaatagaacgtaggctccaccttgcatgtaggggactgtgtcttacatgtcctccatattccagggtccctgagctagaaaggttcttggtagggctgggagctgggatattggggtggaaagagcctgcttcctatgaaacatcctggaaagttgctgtctggctttttgaacacctctaagaatggaaagccttttgttagagccatttcttaagaagtctgtcctcctacactcctgttaattagtgtccgagccacgtggccaagcccaatccctcgtggctggttatccaaccactggcagaatggagccctcttgtttgcctccgagtcctctttttgtcttcgctgttgctcatgtgatgtggtctagagtcctgcaccttcacatcctctttcctctgtgtgggctgtgattggctgacatccttcccacagggtgatgaggagaagcagatttcaacacagatttggcatttccctgcagggcctggagcagcacctcccccgaggctctatccagatggctcaagcctgtcctcacctgcctgccttattccttggacagcaactctatggttcccttcctttatgattgcctttctgtttgaagaactttgcttagcccctcccttccttcccttccttctttcctccttccttcccttccttccttctttcctcccttccttccttcctcctttccttctttcctcccttccttcccttccccttccttccttccttccttccttcctccctccctccctccctccttcgttcttctccctccctccttccctccttcctgccttcctgccttctttcctttgtcacagtctcgctttgttacccaagctggagtgcagtggtgtgatcatggctcattgtagcctcaaactcctaggctcaagcaatcctcctacctcagcctcccaagtagctgcgaccaaaggcatgcatcaccacatccagctaattaaaaaaaaatgtttttgtagagctcagagtctcattatgttgcccaggctggtctcaaactcctggcctcaaggtatcatcctgcctcagcttcccttaagtgctaggattacaggaatgagccactttgactgacctgcccttagccattctttgcgggtaggtctgactgtgacaaattctcttagttttctttatctaacgatgtcttgatttcgtctttatttttgaaaaatgtagaatcctgggttaatagatttgtttttctttcaatatttgaaaaatctgccattctcttggttgtccatgctttctgatgagaaatccattctcacttgtattgtgtttctctgtagacaatgggatgtttatctctagctgctttcaagactttctctttgtctttagttttctgaactttgattataatatatccttttttttttttttttctgaggcgaagtctctctctgtcacccaggctggagtgcagtggcacaatctcagctcactgcaacctctgcctcctgggttcaagtgattctcctgcctcagcctcctgagtagctgggattacaggtgtgcaccaccacgcccagctaatttttttgttttcagtagaaacagggtttcaccatgttggtcaggctggtcttgaacccctgacctcaagtgatccacatgcctcggcctcttaacgatgtgtcttgatgtggatttctttggattcatcctatgtgggggtgcttggcttcttggatctgtagattagtatcttttaccatatttggagagtttccagccattatttctttgaattctttttcagacccacaccctttctcctctccttgaactccagtcatacaaatgttagatattttgttgtagtcccacggtccctggggctctgttcatttcttttttatttttattttttgagacagggtcttgctgtgtcacccaggctggggtgcagtggcttgatcttggctcactaaagcctctgcctccctggttcaagtgattctcctgcctcagcctcttgagtagctgggattataggcatggaccactatgcctggctaatttttgtattattattattattatttttttaatagagacagggtttcactatattggccagtctggtcttgaactcctgacctcaagtgatcctcccaccttggcctcccaaattgttgggattacagccatgagccactgtgcccggccttgttcatttcttttcagtctatattttttctgttggttgctatcgagtaatttctatggttttatgttcaagttcactgatttttttcctctatcatagtcatattaatgctgttatttatattgtatttttctttcttaaattttttttttccctttactcctgtgacagattatgtattttttagttttaaaacttccagttgtttttctttgtgtcttgtgtttctttgctgagacgttttatttttttaatttttattgttattattttttgagacagagtctcactctgtcacccaggctggagtgcagtggtgcgatcttggctcactgcaagctccacctcccaggttcatgccattctcctgcctcagcctcctgagtagttgggactacaggtgcccgccaccacgcccggctatgtttttgtgtttttagtagagacggggtttcactgtgtttgccaggatggtctcgatctcctgacctcgtgatctgcccgcctcggcctcccaaagtgctgggattacaggtgtgagccagtgtgcgagccactgcgcccggccgagacattttattttttaatgtgttttaagcacgttcataattgcaaattgaagcatttttatgatgactatttagaaatccttgttagagaatcctcaaatctgtgtcatctgggcgctgcatcattgattgcctcttctcattcaagttattttacctgttcttggtataatgagtggttttcagttgtctcctagacattttgggtattgtgttgtgagattctaggtcctcttctgtcttctttttttgcagggcatttatcctgtttaggtctagcacacagatctaggtgggattggatgttcgcttcaccactgggccttgctgataccatctcagcaaaagcaggatattgcctcacacccctatgcctttcctcattgctgatgatgggatggaatttcagctccccactgggccctgctggtggaggctttttaaaaaaatgacaatatatgtacaggaatatgtacatattataagtatgtgaaacatatgcttaatttttacaaagtggaagtttaggagcattttacacattttcctatttctttgcatgttcttataaaaacatatcaaattctgggccaggtgtggcggctcacgcctgtaatcccagcactttgggaggccgaggtggatggatcacgaggtcaggagatcgagaccatcctggctaacatggtgaaaccccgtctctactaaaaatacaaaataattagccggacgtggtggcgggtgcctgtagtcccagctactcaggaggctgaggcaggagaatggcgtgaacctggaaggcggagcttgcagtgagctgagatcacaccactgcactccagcctgggcgacagagtgagactccatctcaaaaacaacaacaacaacaacaacaaaaacccatcaaattcttttttgccattagcttctggagttatttactcacctattaactcctcccctccccctgccctccatctctcgagctttcctgtggctgtggggcagggagctgctcttctctgacacgtccttttgtggaatggggagaaaggagggagaggcacaccccatgtgagatgaggggttggcttctgttgggagaagccctgaagggcagctggggccagaagcagcataaccagaaggcgttagtccccatcctgtcattaccactgaattcctgtgtgactccatcatctgcgataagaggggcttggcctagtcctctctctgatcctgtgcttaggttgcatacattattctagagtttcccaggaacttcccagggaacacgtcagcccagtggcaggtgctggttgggaggggcctgttctgtgtccttggcagtgtctgagcacccccacccagcctgtggtactgacagggcctttcaggctctccaggctggggctggccttggagggggtggggcagtggtattttgggagataagccagcacagtgtcagtctggaggcagtgccagcttgcctccattatccgcttttctacctgggggggcgtggcctgtgaagggatggggggcttccagcctttctcctcagcctgggccagggcccaggacacagggcatcagggctctaagggaccaggaggtcacccagtgtctgatcacaaatgacagtttggaagcccaaggagggcagggacttgttggagggcacacagtaatggtgacaaagtcaggactggaaccaactctctgtccacttgcctggaacccttggccatgccctatgctaaccatctttagcctgggggcaccttatcctgagggatgggtacctgagacagagatgggggaggcgcctgagcataccacctcctagggtccctaccaggggcccttgctccccatgctccctgggatctgacctccagctaggcctgggatggtcctggtttataagggggcaacaccagcccagggggtcagaactccccctacctgttccctgccatacaatgtatggggctgagactctggtctgcagcttggatctcaggtctggtcctggaagaagcggtgaatgttgcaggggcgggggcttcttatgccgccagccacttcctctccccacgtgcagtcaggttggtgtcgctctctcaacacccatgtggaacctggctggcgctggttccagagatataaggcatgaatcctgcccccaaggagctcacagtctaggtctgtgtggctggctggtgggccaggagaggggcgggcagttacagtcagcggatgagtggtgctgtgatagggaagtgctggccctagaaaggcagatgagaggcacctcttttctagagagtcagtaaggactccccttgggagcacgtgggtgggaattggccaagggagataggtataaagtgttttttttttggttgtttttgttttgagatggagtctcattctgtcatccaggctggagtgcagtggcacaatctcgactcattgcaacttctgcctcctgggctcaagcaattctcctgtctcagcctcctgagtagctgagattacaggcatgcgccaccatgcccagctaatttttgtatttttggtagagacggggttttaccatgttgcccaggctggtctcgaacccctggcctcaggtgatctgcctgctttggcctcctaaagtgctgggatgacaggcgtgagccaccgtgcccggccggagatgggtataagtaaggggtaggaagggatatgggaaaggcttttggggtggagggaacagcatgaacaaaggccaggagaggagaggagcatgacagctacatcccagagcaaggggagaagacccctcagtgaagtccctgctaatagcccagctacgtgttcaggagactatttggatataggatgctcaggtcatttgcaatgggaagtgtgttcagggtatctagtccttcttgttgctagacatagaaacagctttgttcactttacaaatcaacaagggccaagaggactcttggtgacatttttactgagggaacaggatcagaatttagtagtcttccactgaccaaatccatcagcatggaaagttatagaatgttggtttctgaaatcttgagtagatttctggggtagatgggggctatcccctgtggatgtggagggggctacttatttggtactttcaagagccctcttcccagcttgtgattctgtattgtgagtcagtttaattcattcacatcaagtatttgttcatcggttctgggggtgggagcaggccagtgtgagcacacccaggagagtcggggcaatgactgggaacactgggcactggaggagacaggtgacatctggtttccttcatagctgttgaccctcttccgagggtctggccgcccttccaccaggggtcgatacaggctttgtgagactcgaggcttaaacaatttgggggcttctttaagaaagaaaacaaaattaagtatgaaaatatttttttagaatgagaaaagaagtcacaacaaatgactgagggctggattcgtgtccctttctttctgaggtctcttcaggggagttccagagagcttccaggtggcagcctggctgccctccccacctggagtgccccaatccttccaggcagctcctggctcccccagaggcccggggctcaggttgtgtttgcctcagcggtttccacccatgctcctcgactggcctgctccttacctcggggatttcatgtggatgtcacacctcactgcccctgggattcgctctctgtccatggtcacagtgagggtgagtgcgtgctctgtgcctggcgggcacactgagggtcactggagccaccccagggagggaggatctgcagtcttcctgctaggcatatgaaagaaccaagactcagagagtttgtttcttgcctaagatgtcattgctgggatcagaatccagtctggaatccaggggcttcagagccctggttcttaagggctgtgctgtgttatccatcctcccttattgcaggtaacacaggaacaagcagggggttacctgctggggcctctctccatcactcagctcctgagggcaggctgtgctgcctcctgtgtctctagcatttggcacagagcatggccagcccaccttgggaacacataatgctcggccatccagtggaggcagagtgtggagagcccaggagctgaaggaggatgcagtggggcctgattagaggggcttggcagccatggtgctaagtctggcccttacaccaaggacagcaggggccatgaggggtgtccagcagggcacggccatcggatctgtgttctagaagctccgactcaagcagcgacatgcagatgggctttgggggagctgcacacacaccatctccctgccagagctgagggacaccaaaacctgccttgtcacgtccccgccctgggttcccatggttgagtcgctctcactcacaagctgtgtggcttggggcaagggcttaacttgccaggcctctctttccccacctgggcatcttcatacctgtctcccaaggggaatccgcacagccactgttcctggtttggaggaagagtctcctttctgggcctctgctacagggagttcaggagttccgttcgccttgtcagctgtgacctctggcttggggccagcacctgccccagagggaccttgttctcagtcataattggctggccctccttgctccctcctggatcttggtaaatgacagcagctactcccaaggcctgccctccctggccatctcagggaagaggagagagtcccaggaaggagctaccccgtgtgcaagcatttcagcagcccaggcctcgtggggtgtagttggcctcccaccagccatccctgtgtgttccacacacctgctgattcctttgtacagaatatggggaggagctgcctgggaaaattcatagtatctttgggcgagtggctgtttgcaagcctgcatacaaattgagtccttggcttccactgtgtgccccctggatggtgagggctagaagggggtagcatgaggagtgggactggctgtcattccagagagaggatgccagcctgggatttccgcccaagagcctgggttcagtgagaaagtacacatgggctgctaggattcacattttccaaaagttaaggtggagaaatctggttgggacgaaggccacaggctttctgctctgcaaggatttctggggaagtgatggagagcctaccaagtgctagacaaaattacaagctgttacatgcacctttgaaatccttacagcaaccctatcaagtcagtactattggtgtacccattttatagatgaggaaactgaggtcaagaaaggtaaagttctgaccagagggcacacagctggaagtagcaggatcaggattcaaacccagctgcctgctgccaaggcctggatgctcactctgtctttctgcctctaggagagttagtaaacagaagcagattgagcccagaggccatgtgagcaaaaccaggagttctaccaacaacatccctgcaccaagccagctatgcacttcctggctgcagtcaccaggcaggggggcccagtgctctctctttctgtggtgtccatgaccctagaggacaggtcggccacttggtagtgcctgtgctccggtgagccacagaggcaatgagaccaaggggaaaatctctcggctcggtctctcccccgcgcagggagctatgggctccttcagcgagtggttgctatgcagccttgtttattcaaggagagctttgctgagagctggagcacgccagcagtggagctcgtggccacccagcccctgctcagacaggaggctgcggcccaggactgtgtggctggtgggggccagggtgggccaggcctggggctgccccgtccttgcctccctgggcccatgagcatcaacgtctctatagagaccaaggaccctggattcctccagtgacaggggtttggcctctggacagagaggtgagagacgataggtccaccaagccatctattgtaggtggtgaatgggaggctgggtcaggacccctgaagtccctggagggagggataaagacctgaactggagcaagcacaaacacacagagaaagaaaaagcatcctgctgtgacttggaggctgtgtgaccgtggggatgtctctgaccctttctgggccttcatgtggcagctctaggggaggaggttggactcactgttctctgagcactgggagccaaggaaggaggggctggcctgggctgaccccttccccgagtcatggcctctgtgggcagtgctctctacctcagggtgaacccttcacagggcaacagctccctggggtgctgtgggcgatggtgccgggaagggtgggggcatgctgtggggatggcacccgtgcttaggggtgctggggcaccccgtgagagcataggccttggaggggctctgctctgggtttgaattctaaccccccctctttctggctgtgtggacttgagctctttgcctctctgagcctcaggtttctcatctgtgaagaagggtttaaaaaaagcccccttggtgctgtctgtgagcatggagacagtcaggagggcagctggcacgttagcccatgcgcagaatggaagttactgtttgttgttgatgctgttgttaggtggagattggcatgttcctttctggagcacatttcagtctcctgaaactaaggttttgccagtcacttctccaggacaagggctggtgctggcgggggacctcagagggctgccatttcctcaggagcgctgggaggggagggactggggcccgtactctgtcggagcatcactgaggcaggccacagggcattggtgcctggccccaggaagtggtgtgaggggcccataatcgcttctatcctgaactgggcagtccctcgctcttctcaccaatgccctgcaggagacggccctgcagccttctagccacaggctggctcccaggactggctcagtttcagcccatggagcctgagactaacagatttgaagaaagggggaggtagttgggggcaagggatggggagatgtcaacctgagctctggagagacctgcctctgagggcagcgcatcctcccattgaccccacggctacctcagaggcaccagactctgctcactagcacagaggctggaagtttattattgcagacagaagaatgcataaaatgcatgcagtgtgaggaataattataaagtgaatgtccatgtagccacctcccaggccaagaaacagaaaaactggccgcctcccagaacccacccccgtgggccctgtccttatcacagctgcctcccttccccttagggttaatcatgctactaatttttccttgattttctatcaagttttccatctatgtctgcatttttattttaatttaatttcgcttcattttttgagacaaggtttcactctgtcccccaggtgggagtacagtggcatgatctcagctcactgcaacctctgcctcctaggctcaagtgttcctcccacctcagcttcccaagtagctgggtgtacaggtgcacaccaccatgcccggctaatctttgtgtgtgtgtatatataaatatatatatatatatatatattttttttttttttttttttttttttttgtagagatgggttttttccatgttgctcagcctggtctcgaattcctggctcaggtgatatgcctgccttggcctcccaaagtgctgggatcacaggtgtgagccaccacgctgggcctatgtatgcatttctaaacactcgatgtaattttgtctttctttgaactttatagaagtaggggcataccctgtgtggtctcttgggtctgtcttctttcactaaacattacgctgtggcatcgtccatagtgttgagtggggcagtcgtttgtttcattgctctgtaatattctatgttgtgagtgcaccatgatttagtccttcattttcctgttggacatttagattttttccagattttggccattatccatggcactgctctggacactctcgagctcctttcctggatcacctgtgcaagactttctcaagggtgggttcctaggagtggaattgctgaacattaggtttgtgcatttttagctttatcaggtaaagccagaccactttcccaagggtttgtgcccatttgcatctcacctgccagctgtcatgagtgctcccattgctctgtgctctcactagcacttggcattgccgcccatctcaatttttgcccatctttgtgggatggtggtagcatctcatttgcattttcttgattaccagggggttgagcatctgcccccagccattcttcctcacctctttcctcctctgttgggtgcctcccttcctctgctctctgtgatctcagcccctcatggtgctcaggcttttgagccccatttttctctctgccctccccactcctccatccctctcctccattcttcttcttggagaaccaatcactattccacatacttcttagtgtttgaattacagacccaggctccagagccactgtctggaagtctgagtttcccatttcgtgttttaaaacctctggttcttggcccaactcacatcccttcctgggtcttggatttctcttcaacaaaacaaagacagaaaaaaaaatgtccctccacagaagccatttatatttcccaggcaaaacctggtgtatgtcctggagaggcacacacaaaactctggctcctattcaagaaagtcggctttctcatgggccattgggaagggacagggccggggtctgaagtcttctgagcttcttgcagggaggcctttgccaagagccctttcctggggtgtgacagacattcagatgctagagtcatgccaatacacctttgctgagactttggacaagatgctttcttgcttcctagtcccttctgatcctctgagtacatgtgcttgtttacagtctacagtttgaagattcaagctcctgctactgggcaggaatcctcaactgatcagccaaaccctgcagaaggcattcctggggcagtggaccaagccatttttcattcgagactccaggactatgatcaagtgctaggataactcttaccttgatggtggaaatctcagggccagcagaagacttccaagccccagccaatggctgtgtgatttcaggcaggattgatgcggtggtatcctacccctcccaaaaccttaatccttgggagcacactacacaggctctgaccaggcactgtagtggcaaggtgaccattttggggaggccttgatgggaagctggaaaaggaagctttcctcccagtcctgctgaaggccttgccagctggcagccagtgtgatgcctataggggtatgggccctgggataggtattggctcctgatggccttatgtaggtgttatagactgaatgcatgcgtcccacaaatgcaaatgttaaagcctaaccccccatgtgttggtattaggaggtggggccttcgggaggtaattagattcagatgaggtcgtgagggtggttgtctcatgatgggttagtgcccttagaagaagagaccagagagcttgctctctgtctctctctctgccatgtgaggacaaagggaagacagctacctgcaatccaggaagtgagtcctcaccaggagtggaatcagctggcaccttgatcttggacttcccagcctccagaactaaattgctggggttttttttttgttttgcttttcatttttttgttttgtttttgtttttgttttaagtcggagttttgctcttgttgcccaggctggagtgcaatggtgtgatctcggctcattaacccctcatttacaagggaggaaactagctgacctccaaggccccttccagcttgaaatttagtaacagaagaaaggcatgggaaattctgttaaattactagaccaagttctgattaatctctaatttatatttgcaccaacacgatacacaaaggtgggggcaggttcagaagattttgaattttgtaaatttgtgtataagttacatacgctttgttactaggaccacagcccactcatatggttcctttgtgaattagaaaaagatgtctctttctcaagacacttttcttctattcatcagaaaaagactgaaatgaatgtacaaatatgtacagtcatcgtctaaaacaacattgccaggactttggagaagatgtagtgtgaggcttatgcctgtaatcccagcattttgggaggctgaggtgggtggatcacttgaggtcaggagttcgagaccagcctggccaacatggcaaaaccccgtcactactaataatacacacaaaaaaataactagctgggcatggtggcacatgcctgtaatcccagctacttgcaaggctgaggcaggagagttgcttgaacctgggaggtggaggttgcagtgagctgagatcatgacactgacctccagcctggccgacagagtgaaactgtgtctcaaaaaaaaaaaaaaaaaagatgtagtgtgagagatgtctccttaattaggatgccctcgtgcagtgcccaacctagacaatcaaacatggcagccctgcttgtcacttatctcattgtttttcaaaaacagcctaaataaaactttctctccccctaggctttcctatgtcttttagactgttaattctcacatcagaatttcctggggttgtggaggggggatgttttaaatgctgcggcccatccacccccaacccgagatacccacactgagctgctattacaaatggatggccacattcctcggctgcgttgggcataaaacagttgggaagtgctgctttgggtttctgaccacttcctctgccctgtcctgggaggtcattagattcaggtgtgaactgcctcctgaacagactgttctgttaagaaaggttcttcccagcaacgtgctacttgacccctgttgtaagtgtcccgccccagcctgcccactgcttcctgctcaccctggacagctcaggaaatggaaggacctcctgctgcacaaggtggcacctccgtgttgctgtccagcctcagccaggcctctgtagcttcttggcccaaaggctttcaaaagggacatttcccctcttcctgaacatctgaacacagcaaaacagttactaaacaaccaatactattaatagccactgtggatcgagcccttgggcccaatcagcctattaaatgtttctcatattttgtggaatattctcaataaccttggagatagatattattatttccatttcgcagttaaatggagactcagagaactttaatcatgtgcctgaagtcacacagctagcaggtgatggaatttaaccctgttgactcctgaatgaatgccctgaaatactgccacctccgtgaacagaaaccatcagccccgactcttctacttagtagctctgtggcctcaacctagttacttaacctctctgaacctcaatcatcttgtctataaaatgaagatgaaaatacatactttctttctctatttccaaagctcaatgacatagtatttggaagcacactgtagtacattgccccgggcgcaaagcaaaatggaactaagaaatgttaattccttcacttaggttcttctcaataagactgtctggaagatgtgctttagtgtttttttatgagacggagtcttgctttgtcacctaggctggagtgcagtggcatgatctcggttcactgcaaactccgcctcccaggttcacgccattctcctgcctcagcctcccgagtagctgggaccgcaggcatccaccaccacgcccagctaattttttgtatttttagtagacatggggtttcaccatgttagccaggatagtctcgatctcctgacctcgtgatccgcccacctcggcctctcaaagtgctgggattacaggtgtgagccaccacacccggccaatgtgctttagttttgaattcattcattcagtcacactacagttactgcattattgccatgaacctggcactgtttgtccctttgtctgcattctgtggaattgctggctggctgcaccctatattgtctgagaacagagtggctacaggagtattaaccccacctgatctcacgatgggagaggagacgccatctgcagcagtggtggtagacccagagctggtaaagagttgtggtggggggcttctcatctgcgaacggcctttctgctggcccccacatgccagtcacagctggagtcaggggcctgagtggcggggggccttggatgcccccacagggggtctgatgggtgtggacatcagtctcgcagttgggggtgaagtggctcttgggactgccagctctaggagtggccgagttgagggtcagtgtggaaaccagccctgccccaagctaataaagatggacatgcaggtggagccatccaggcctccttgcagcttgtctgcagctccagagagggaggtctgggctctacggtaggcttggaagtcccgataatcagatggcaattgaaatcacaagggtaggtgctgcctgtaagaagccctcctaataaagatggaggcatctgggagaggaaaggaaaggaatggtttggttcttctaaagtcagaatatgtctccgtgactgttcagaacttcacactcctgagtccagctctcatgtgcagcagactcacctccctcttcactgccaatatcaaggccgttctacgtgccctttctctcttcctgacctctccctctgtaggacccttggctcttcctccagggtccgaggactggtgctcccatctggcccagcctgtgcccttctccctcagctgttagcactgggctcccgctccatcagctcccctccctcccctgtgtcttcagccttttccttctgactctttctcctcctcctgtgaacacgctctagaatctcctaccctgaaaaatacagagaacaaacaagcaaacaaaaaatacagagaacaaacaagcaaacaacacagcttcatccacccttcattcccctccagctactctccaacctctctcctgcctttctcatccaaattctccagcgttgtttggactcaccatctctataccttccactcacgcctcagacctcagcaattttctgtgacccgcatgcctccacaggcacagaccttgctctcactaagctcccgatgattccataatggtcacatccaattggctgagctgacacctctaaccactctctgctcatctggctctcctggcgccaactcccctggcctccctggctgtccttgatcagacccccttagggtctccccttctctacccatctctgctcaatgctgctgctccctgggatgttccttagctctgggcactctcttgtggtcaggtttttgtatttttattttttgagctggagtcttgctctgtcgcccaggctggagtgcagtggtgtgatctcagctcactgcaacctctgcctcccatgttcaagtgattctcctgcctcagcctcttgagtaggtaggattaaagacttgtgctaccacacccagctaatttttgtattttttggtagagatggggttttgccatgttggccaggctggtctctaactcctgacctcaagtgatctgcccaccttggcctcccaaagtgctgggattacaggtgtaagccgccataccgggcccgcttttcatattttattgaatgcaatattgaagtgagataagcattatctcctttttttttcttttttgagacagggtctttgtcgcccagactggagtgcggtggcacaatctcagctcactgcagcctcaacctcctgcgctcaagtgatcctcctgcctcagcacccccaagtaactgagactacaggcacaggccaccacgcctggctaatttttgtatttttgtagagatgaggttttactgtgttgcccagtactgtgttgcccaggctggtcttgaactcaagcgatctgccagccttggcctcccaaagtgccaggattacaggtgtgagccaccatgcccagccaatttttgtattttatagagacgaggttttactatgttggccaggctggtctcgaactcaagcgatcagacagccttggcctcccaaagtgccaggattacagcagtatttccactttgcagttaaaagagctggggctcagagaagtttagcaacgtgccttcagtcacacagcttgcaggtgctggattttagtcttattccccttcatatcttagtacctatggcatgtttgaatgaatgagtgaatctcacattttcagtggcaggccgaactctggaggtcagagtctcataagttggtcacctgacaacatccagagtcctccctgcaggtctacggcctgggctgcctcccatgaggggagcagaggtgggtggaggggtgagatgtatgtgtatggtgattggaagcatgggtagctgtttcttgtccacagggagacagcacgagatacaggaaggcatgttctgtccagtctaaaccctgcgtataatcagtgtgaaatcctggttaagttgtttattttctgtgcctggtccagaggctgggctgacatctctacatgtcagtgctgtaattctctccgaggctccccttccttaggaagtccttccaaggccccacttgaggggtctgcatgaaactgcaggtcagataatgccattcctctccttgcacagtcttcagagtttcccggggctgcagagcaagccccgaccctctcacagagcattctgggtctcccccgatggccctcatcccgctccccgggcctggatcctcttgccagaccccagactcacaggcgcatctcctccacgcttgccttaggccgcctcctcggcctggaatgccattcctccttcctacccgtttagaccccatttcctacccgttttgatcctacttccaggcccagcacggatgctgcttttctgtggagcctctccggtgccctagtcagacagtatggagggtatccctgagtgctcatctctgtagcagggttactttgtcctgtcgggcgtgacagtgaacgttcaccttctctgcttggcattacagacagcattcgcttagaaatgtgggctcatgggtgagagctggagggggtcgaaggcaacatctagtttgagcctcttattctatagacatatctgtctcctccgcatgagaggcgtctctgtcacctgggtctgtcttataggaatggagggccggcctgtcataactttaaagacagtgtgggtgtatggacatgcgagtgtgtgtgtgtgtgaagggtgtgtgtgtgtgtgtgtgtgtgtgtgtgtgtgtgtgtgtgtgtgtgtggcttttccccagggaaaaagaaggaagattcacacctgacattattgagcaattactatatgccggcaataggactgttatttctaacattacttcatttattcctaacaaaaccccttgttaggacatttttttcagatgaagaaactgaagctcagaggaattaaatcagcttgccaagtttacacaagagggcccggggcaggattccagccccactgtgtctgagcccacagccagtgttctgggagttctgagttggacactgggtgcatactggcttgtggggtgtgagacgggaggggggcctagatctgaggcctctcttccgagagtgtgtcagtgggggccatgtttttggttccagaatgagagtttgtaaacgctgccacctttcccctcagcctggctcacccctccttcctttctctgtcaccttggtgtgggctctactgttcccaccagctttgtctgaggagatgagaactctggctggagacgtctcagaggtctctgaaagtcggagcgggtggtgtcatgacagaaagagaagctgtgggagcggcagccccagggctgtggtgggtgggatgagtctgcccagctccttgggagcagagtgggcgtggagctgcacgctccctgtggactgtgcgaggcccgggtggttggggttttgtgcttgggactgaacttctttactgggccagccctagctagcttttgttccctttccacttgacacttgagtcccctgtgtcacctttcttcattcctatggccccggtcactatggaacctctgtagccatagcattaatgggaggaggggacaacggttacttaccccgggtcgccccattccctgggctgggaaacggaggctgagaggggagaagccagccaggcagagcaattcagagcatcaggaagtgaggacaagatcctggtcaccagaatccactggctcatttagccctttgggtcaggggctggctgttctaacaggggagagtagcgccttagtgtccagagcagtgctgggtgtgatggggcctcggtgaattgtgccttgggggtcaggtgctcagtggtgtctgccctgtccacacttgtgctggacttcctgattctgatttttatagtttggatatggatcattcagttcctacaggtccctgggccaaagtgatttcctggggtggtgcctctcactgcgctcacgttagtcaggcttgtttgtccatagcagctttggccacctcctcttgggcgggcacctaggagatcctgcactagaccctggggcctgaagggtcgaaggtgtagaccctgagagggtctcaaaggggctctgctggaggggatgctttggcgagccatggaatggctccagatttcctttccatactgctggtgtcctgggaccagggggaacctgggctgccttggcatgttgacctctgaccactgaggaggctacggtgggaaaactgtcttgttcagaaggcccactgcagtaggggtggctgttgaaacttaagcatcccgtaacctcaggcggctcgagtcttctttttagcctcctagagagtgatcactttggggaaactgaagcagcaatgaccattctgacagcctagggtaagaaatagggccgagatcttattataaagtgaatctgaactacagaccagtgattttttgatcctgtctgaacatcaaaatcagaagttaaggctgggtgtggtggctcatgcctgtaatcccagcactttgggaggccgaggcaggcagattacttgaggccagaagtttgagaccagcctcgccaacatggtgaaaccccatctctgctaaaaatacaaaaattagctggccatggtgatgtatgcctgtaatcccagctacttgggaggctgaggcaggagaatggcttgaatccgggaagtggaggttgcagtgagccaagatcatgccactgcactccagcctgggtggcagagagagattctgtctcaaaaaaaaaaaaaaaaaaatcagaagttaaagaaaaaaaaatccctgtggcctatttcctagacctaattcagcaggggctggaggtggggcgtggaaatctgtaattttaattggtttccaggctattgtaatctgcagttaaggagaacaaagactgtagctaaatattgcttttctgcatataattttcgtagaaagtgtatcctctggttagagatatggggaacaggtggggcttgcaactctcacagcccccaaatcccaggaccccagcttgtttgctataattcagccatggaaggtctgtgccagcctgccacattcctgctggactttgtctggaaaccagctgcctggccaatctcttgagcctcttccctagctcagggggtgaagtttggggtgttggtgcctgtggaatagaatcttccctcgccttgtctaggagaggtgctgtgtctcacaggggttcaggactgcttttcaccaccgtgtggccacatccttatcccagtagatattaaacagagagttcccctctccctggttgtgaggaaaattctcctcagacagggaactcatgtcttgaggttctaagcagtgagaccaggctggggccaagctgggctgggtgctgggctgggtgctgtgctgggccgggcactgggctggacacctgtgtttgggttgagggttgctaggagctactctgccttctggggcctgggtggggcagtggctggctggcttccagacagaaggcaagtttctcagttcctgagttgggatttgttgctcagaaaagggagttggcacaggttcctgccctgtccccagacgctttgtggacgagaactcctctctggggtagaaattaggagctgtgggcttcacccctggtcttaccacagatcagctctggaagcacctctgttacctgtcaggggaaaacgggtcaccattatcgcagcaaaggattcatagaattgtgtgaagctgcagagtgtgcagtgagaccctgtcacatggaaataaaatgaagttaggtcaagggcaagagctgagggctgacccagaggctgaagggagggctggagggatcaaggtgtgggcaatgcggtggctgaggggggtcacaggtgtggcttgttcagtcaggtgagaaggagcaccaaggacgtcatggaggtcatgaccgcgcatcctgagagagactggagaactggtgtccgagaggccccgccaacacctgtgtgatcagtggttgcagaggccaacatcgccatgggctttcagggcagctggcggactcaggggcatctgaagcaaattgaaactgatggagaaacacagtgtcagacactaccttgaaaaaaatcatctttccccgcgaccctaaaggtgtccatgtctcagtgacaagggatggcaggttgatgggttttgttgacactcttcataacgaactcttcccaaaaccacacggcctcgcacttgggaactgaaacatttgtgagtccaatgtcagaaaaatggcatcctttggtttagtggccgatttcttcatgacaataatgctttagcccctgaagggctttttgtgaagtagtttaaaagtgttaatttgcttttactgacttctcctttctcctctcacccttaggtcccggatgttacaggtcagagccctccagacccccaaggactgtactcactgcccagaaatagctgctgcctctgggcaaccttgtaggcaccttctccacccaggacatgggcacccgtgacgatgtccccgaaggtaaggggcaccatgggaggcctgctgctggtgttttccaggctaggggacctgcctcggacactcccaagggccagaaaaagggagatgtggggataaagggctgctgggagataacagccaggtggccgtgcctttccagccctggccagctccccacatgctgccgctcagctggctgtctgggtggctccctggcctaaggaggtgcttggtgttccagggccttggcctgagctttatctccactctctgcagcagggtggttggttccttgaggggctaattctgttctgtggtcaaggttatgtggatgggcaggggatatgggccgggccctcagggagggtgaacgactctgtttccttagccaaccaagtggggtagtgggagcagtgtgtggccagttagcatcaggagatgggccttgaggcctggctctgcttttgggagctggctgggtgagcctcagtttcccctggaaagtgaggggattggttctgccccagatgaaatgggtgctagcaaggtgcagagctgcttcatcctgcatgggctggagcaggggccagatggccatttggaaggaaggcagagaagcaggatggccagagcagcggttcaggagacagcgcatgatgcacacggcagaactccccggggcttcgacatatgaatcggaaaagacctgcttactttagtgctaaagcagatcccacctgaatgtagattccagtggagaagtgggaggtgctgagatcttagaaagaaaaatctacaaatctagaaataggataaagatgttgtatgaacctttagtgctgtcaactcctttgctttactgatgtgggaactgagactcagagaagttagcttatttcctcaaggtcacacaggtggaaaaagtgggaacccaggctcctgagttccagactaggagtcttgcagcctggggatggacgagctgggtttccacctgcgtggtggcttctccaggtggtggcttaggtccccatggatggtcctgaggtgggctcgggaagggctgagccaggagggtgtgggacccacgtttgtgaagtgcctacttagcagcaggtacagtactacagagatgagtaagacacagtgactgttcctagggaagctgcagggcaggaacagagagaggcatggggaagagagagtaacacagggctgtgcctggggctgtgggaacacaggagagggagggcttctctttctcttttaaaaatattgacacataatagttgtacatattttctgggtgtacatgtgatatttggatacaggcattcaatgagtaatgatcaaattagggtaattgggatttccagcacctcaaccactggccatttcttgatgttgggaacattccaattctagctattttgaattatacaatacattattatgagctatagtcaccctactatactatcaaacaatagctctcattccttctatctaactgtatttttgtacccattaaccaacctctcttcattccacccccttctcttcccagtctctggtaaccaccattctgttctctgcctctgtgagactgactttttaagctcccatatatgaatgaaaacaagtagaatttgtctctctgtgcctggcttacttcacttaagataatgactgccaggctgggagtggtggctcacatctgtaatcctagcactttgggaggcagaggcgggcagattgcatgagctcaggatttcgagaccagcctgggcaacatggtgaaaccctgtctctatgaaaatacaaaaaaattagctgggcatggtggcaggtgcctgtaatcccagctactagggggagctgaggcaggagaatcacttgaacccaggaggcggaggttgcagtgagccgagatcgcaccactgagactccatctcaaaaaaaaaaaaaaaaaaaaaaaaagataatgacctccagttccatccatgttgctgcaagtggcaggatttgattctttttttattcttttttatggcctaatagtatcccattgtgtatatgtgccacattttctttatccattcatccattgatggacacttaggctgattccatgtcttggctattgtgaataatgtaataaacatgagagtgcagatagctcttcaatgtactgatttactttctgttggatattcatccagcagtgacctcaaaagcacaggcaacaaaagcaaaaatagacaaatgggattccatcaagttaaaaagcttctgtagacacaaggaaacagtcaatagagtgaagaataggagaaaatatttgcaaactatccatccgacaaaggattaataaccagaatatataaggaactcaaacaactcagtaacaaaaacagagaatctgctttaaaaactggcaaaagatggaaggcttcttaaaggagcgcatgccttagctgaacttcccctcctctttcctgactcctgctccctgtatgctctcagctcagtggtccctccctctgggaagctttttctgtccccatctctggccgggctcccaggccccgcactgtcattgcttcttaatcattgtgttctccgccagacttcaagtctcactgaggactgagtcagccttgcccactactgtctcactgcacagagagtgttcacaaatctctgtgtcgcggatagagggtgtcttttgctgagccgagggacgttaggagagaagagggaagatcagtgtaggacatgctgatgaggtgcctggggacttccaaaaaggaattggcaaggtaattggatgctctgtaacgggtgggattggtcagggcggaagccgtagggtaggggattatctgcagggtgtggcagtgaggaagtgtcctggggagagcagctggtggacagaggttggggatgggcactccatcggtcaatgatgttgggtgatggaagaggggtgcccatgaaggagatgaaaaggcatggaggggggtttggaacaaagccaggatgcgaggagggaggaggcagccaggctgagaggctggggcaagcggggttggagggatttggtggagatcacaggcaccctgcctggccctgccaggctctggtgttgggggtggggccaccacatgccttggttttttgggcagggaccctgcggggtggagtgctcagggttacggccgggtgttcttggtttgctcccagtcttggccttggaggactctcaggtgctgctctcctgtgcttctgtctccagccaaggtcctggtccccgtggccgtgtactgcgggagcatccctcggaccagtgctgggccccgggtgctcccgcctggaagcatcaactccagtctgcctcatggagaaggtgagatgggaagacctcacctggtcagggcccctggcctcatcctggagcggggagtgagtgtggtagatgccggctgtgttctcgagctaccagcaggtgttatttttcctgtggctcctgctgaaaataccctttgattctttcaaaggcaggttcttttgatcctgtgcctcagaggttggaggtgtgcagagggggacccgcaggaatagggagcagggctctctgcatgcgcctggacctgggagtgcactcagcacccaggttggcaatggggagggggcccctctcaagatgtccactcagcgtctctgccacttgtccagcatctgcagcctgggtctctggaggggctgggttgtggccaagcttctgagagcccacctgtctgaatgctcccccagggcccaggtgaagagcaccacttcctgaaggtcttctagaacctcttacctcctctaaatgtgcagagtattttgtttctctcccatctggtgtgtctgctgggggtgggggtgatttgctctgagatgcctgagttcctccttgtagtctgtgcttggcataggtcagtgctcggggatctgatgactttgttggaccctggagattggtggatggtggtccctgggcagacgaccttccctatgattcacggcctcttgtctgtgctgccataggactgcctgtggattcccccttttgtcctgagcaccttgtggcatgggtcttgtgaagattaggtgcttcagagacactgtcgaatgaatgactcgtccccaggagtgactgaaacattaaatgactgggtttcaccaggcaagtggctgcctgttagaaggaagcaatgtcaaggagcttgctggtgcctggtgccaccctgggtactgcgtgccaagccattcacacctctgtccccctcaggttctctccagcctgagccaagagccctgctgaacaacgaggaaccgtcacagctcctgcgtggactcggacagctgggtggcctcaagctggacaccccttccaagggctggcaggcaaggaatggtcaccccaggaacctcagggccttgtctttgggggaccagcccctggtgctcctcccttctccggagtcagaggccaacagcgtggccagggacaccatccagattaaggacaagctcaagaaaaggaggctctcagagggcttggcagcgtcttcccgaggtgagcactggcccctgcccacccctcacccacccacttccaggtcaagggccgcaggcctccagggctgtgagggtcagcaggcttccaggtggcatgctgggatgccctgggggtgatcggtgggtacataccaggtaccttctctatggcttcagcgacctccttggagctgagcctccctcccgggctctgcagtgcttcccgactggcctcttcattcccacccttgcgccttctagtcttgctccagaaggatccttttaagcaaatgttcttcccatttccaccaactatgctcaaaatcagccagtaggttttggatgtgcttagactaagatcccaaatgttcccttatgcacaagaccttctggccctggcctcaccccaactgtgtcactctctgccttcggtctctgctgtccagggcctggggcttgtgggctctttcctgcctgaggtttagagccactgctcctcccccacccctcctccgtttcccactcagaaaatccccacccagcctcccttcttggcttcaaagccctcctcaaagaggcctccttgactccccaatgtgagtttgccccttaggatgctctccaataatgccctatcatttttttccttcagttcttttcatggtttgcatttatatttttacttttgtgactatttaaaacctgaatcttgcatgtaattgtcagctccaagagggcagtgactgagatctcggtgtgaggcacagtcgcttggcagctaggaggctctcaagaaacgtttgttgagcagatgaacaagggattcaacagcaggcactttatactgtctctcatctgtgtggtggacaagccaagttcaaatcttagccccgatactcactggctctggggccttgggcaggtcggtaacatttcaggcctcgatttcctcctctgtggaatggggacactattaataatacttctgtgttactgtgggggtttaatgaaaacttgtacacagaattctcaacacctggcatatgggaagaacttaatacattgttactattttccttccttctctcctcttctgggtgaatcatacgggctcttttcagcggaatgaactcttgggtaacaagagcaataagaagtcttgaggtcttaggaagaaaggggaagtgctctcaagaggcacgtggttgctgccgtcaagcctggggttgtggttggctgttcttcccctcccctgtgcagactgctccacctgctgagcctctccctggagccgtggggtgtctccagctcccggggagcccaggacaatgccagggagcctctgggaggaattgtcctggctgcacattatggaggcagaaggtggggttggaatgcccgagaagcttccttagaacttccagtaggtacaactcctagagctgccagaccaacaactctctcccttaggggcttgaagcccttttctagatatttcatttcttttttacaaagttccagcatagggaaaaaaagaatggagttgttctacctaatgttctgatgggcagtgacctatagacttatcaggcccctcagcaagcatggagggccggggatctctggcccccgggcagtgctggggctgctctggcccctgcattgaggctgagttgactcctctgtgccctgacccagctggggctcaaggtggcccggcaagtggcacagtctccacttgaccacaccccttcttttccatcctttcagctccccacaggctaaccacaacacaacagtgctccaagacagaacagaaccagcaccggaagccaggaggggagcgagtgtgcaggaacagagatgatattttgacttggctggtttatttttttttaattttttttttctggaacagagtctcgctctgtcacccaggctggagtgcagtggtgcgattttggctcactgcaacctctgggttcaagtgattctcctgcctcagtctcctgagttgctgggattacagacaaccaccactaggcccagctaatcttttttttttttttgagaccgagtcttgctctgttgcccagtctagagtgcagtggtgcgatctcggctcaccgcaacctccacctcccaggttcaagcgattctcctgcctcagcctccccggtagctgggactacaggcatgtgccaccacgcccggctaatttttagtagagatggggtttcaccatgttggccaggctggtcttgaacttctgacctccagtgatcctcccgttctcggcctcccaaagtgtgtgggattacaggcgtgagccactgcgcctggcctgacttggctgttttgatgcagtggttttgttgaggccagaatgaaagttaaaatgctagtcttttttttttttttattcctcatcactgatatttacaaagataaccctgagctcttggcccaacccagtgcttcttgccctgtgcctttgcctgaggcatggctgtggggtgagatggggtggggcacagggcgctgaagatgtctgttgggcacctaaagcattcagaggggagctggaagtgtggcggtctgtcttagactatgttagctgtgtcaaaacagctacgccccacatcaccagccgaaaaggaaggggaaacagtggcaggtacttgcctggcatcttatataagtgatgttattgaatcaccccatttcacagaagtgtaatggggttcagagagacagtgccttgctcgaggtcacatagcttctacccacggccaggacctgccatgcttcctcctgatctggcactgcttttatttcccttccttcccacgctgcctctgaattctaaacaggtaacttggattggccctttctggaatggcacagacactcagaagtggctgcttgctcagtctaccagtggtggggttggggacagatctgatctctctcctcgccatcccagtccttcccagggcagaaggccccgttgctggggtctgaatccaccttccactccctgttcttctgggactaactgatttcccatccccatccctgtacagcctctctggatccagggggaggcccccaaggagttcccctgcacagcaccatcccccgagccacctctcagaggctgctgagggtgcccaggccgatgcctctcatccagagcatccctaccacccctgaggccagcggagtcaaagagaagggcctggacctaccggggagcattccgggtcctcacgagttgagacccggtgctcaggaggtaaggtggttcgactgctgtgagtctggtcctcagcttcttgccctcccttcctcctgcctttctttctagcctccaccaacccctgactccatgccctgagcatccctggaggtgtcttgaggtctgcagtgaggatagggacagcactgggagaggctcaaggtgctcatttcaccacctcccccagcatctcaaacctccatagctggcctgggggctctgggtggctgtgccagaggctgcatgacctttgtcctagaactggtggtcccctaggccttctctggtctaaatgttccagaattcctcctgctttctggccctctccattttaagcaagagtgtggcaaagaatgctgggctaggactcagatttgggccttggtttctgtttgcccctcactggctgtgtgaccttgtgcaagtcacacccctctttgggccccagtttgcacatctatgaaaatagaggtttggcccagatgtgtttgaaggtccttccagctctgatgttctaggatttttctgaaatgagaacagaaaaacgaataataatagtcacaaaagggcttgccagtctcctcaccaggagtggtaaggaagcagtcaggcttctgggggtcccagggtggtgtggctgaaaagagacagcaggtcccacactgtgtgaggtgcctggaggtgagcattcaccatgggatgttgccataggccagacccctgtcccgcctctgctcccaggcgcagatctcctggcaatacctgcactgcaatgatgagaagatgcagaagtccctgggcgccatcgtgatcccacccatcccaaaggccaggacggttgcagcgaccccctcccgtgtgcctggctcccttcccagcccgttacctccaggccagggagtcctcacaggcctgagggccccacgcacgcggtaagagctccaagtcaaaccttccttgctgacttctctccctctgtccccctgagatccactggggctccttgtggctgaccctccatgctgtggcagagttcttgggacaccaggcagggaaagggctgggggctccacccatgagccacagacctagggaggtcccagcatggttgccggggcttctctgcctcttggctccggcaggctgggtcaatggcatcacgaacaatgtctccagcctctgtcttctcccagtgccttagtggatgaggttgccggagtaatgaataaaacactaattattttatctcatatatataattttgagatggagtctcactctgtcgcccaggctggagtgcagtggtgtgatctcaactcactgcaacctccgcctcccgggttcaagcgattctcctgagtagctgggattacaggcacccaccaccatgccctgctaatttttgtatttttagtagagacgggtttcagcatgttggccaggctggtcttgaaactcctgacctcaggtgatctgccctccttggcctcccaaagtgctgggattataggtgtgagacaccgtgcccggctatgaataaaacactattttaaagcatgattgagttcatggcagctctttgtaattaaatattttcttaattgatggatactaaaaatacaaccagtatcatgtgtatgggggacagtccacaaacttttggacttgaaaaggggtcttcatatcccacaaacaagtggggaagaggatctttgtgttggcataaatcgggttatggcttgtaagtaagacagtgctctagatggccagcaacatccccgtggtcagtccagagtgatgtcagagcacgtgtgtgtgagagtgagtgtgtctgagtgtctttgtgtgtgcacacatgtatgagtgcctgcaggtatgtgtgagtgtatgtgtatgagtgtgtatgtgtgcatgtatatgtgagtatatgcatgtatgtgagtacaagagtgtgtgtgtctgagtatgtgtatatgtgtgagtgcatgcatgtgtgtgtgtgtctgagtgtgtgtgtgcatgagtgcaagagtatgtgtctgagtgtgtctgagtgcatgtgtggagtatgtgtgtgcatgtatgtgtatgagtgcatctgtgtggagttgtgtgtgcatgtgtgtggagtgtatgtgtacatgtgtgagtgcatgtgtgtgcatgtgtacgtgtgtgagtgcatgtgtgtgcatgtgtgtgcatgtgtatgtgtgtgagtgcatgtgtgtatgtgtgtgagtgcatgtgtgtgcatgtgtatgtgtgagtgcatgtatgtgagtgcatgtgtgtgcatgtgtatgtgtgtgagtgcatgtgtgtgcatgtgtatgtgtgagtgcatgttgtgagtgcatgtgtatgggtgtgtgtgcatgtgtatgtgtgtgagtgcatgttgtgtgtgagtgcatgtgtaagggcatatgtgtgcagtgtgtgtgtgcatgtgtgtgggtatgtgtgcatgtgtgtatatgtgtgtgggaccatgtgtgtgagtgcatgtgtgtggagtgtgtgtgcatatgtgtgtgtgtgcatgtgtgtgtgtggggtatgtgtgcatgtgtgtgtgagaccgtgtgtgtgcatgtgtggagcgtatgtgtgagaacgtgcatgtatgtgggtgcatgtatgtggagtgtgtgtgtgcgtgtgtgagagcatgcatgtgcgtgagtgcatgtatgtgagagcatgtgtgactgcatgtgtgtgcatgtgtgcatgtgtgtgagtgcatgtgtttgtgtaactacgtgtgtgaagccatgtgtggtgtgtgttcatgtgtgtggagtgtgtgtgcatgtgtgtatgtgtgtgagggcatgcatgtgtgagcatgcatgtgagtgcatgtgtggagtgtgtgtgcatgtgtgtatgtgtgtgagggcatgcatgtgtgagcatgcatgtgagtgcatgtgtggagtgcgtgcatgtgtgagtgcatgtgtgcatgtgtgtgagcacatatatgtgtgtatgtgtgtgtgtgagtacatgtgtggagtatctgtgtgtgcatgtgtatgagtgcatgtgtgtgagtgcatgtgtgtgcatgtgtatgtgtcagtgcatgtgtgtgcatatgtgtcagtgcatgttgtgagtgcatgtgtatgtgtgtgagtgcgtgtgtgtaagtgcatgtgtgtggagtgtgtgtgtggggtatgtgtgcatatgtgtatttgtgtgtgagaccgtatgagtgcatgtgtagggtgtgtatgtgtgcgtgtgtgtgtgagaccatatgtatgtgagtgcatgtgtggagtgtgtgtgtatgtgtatgtgtgagagcacgtgtgtgtgtgtggggtgcatgtgtgtggagtgcatatgtgtgtgcatgtgtgtgagagcatgcatgtgcgtaagtacatgtgtgagcatgtgtgaccacatgtgtgtgcatgtgtgtgagtgcatgtgtttgtgtgtgtgactgtgtgtgaagccatttgtggagtgtgtgtgcatgtgtgtggagtgtatatgtgtgcatgtatgtgtgcatgtgtgtgtgtgagtgcctgtgtgtggagtgtgtgcatgtgtgtgtatgtgtgtatgtgtgagtgcatgtgtgtgcatgtgtatgtgtgtgagtgcgtgtgtgtgagtgcatgtgtgttcatgtgtatctgtgtgtgtgcatgtgtgtgcatgtgtatctgtgtgtgagtgcatgtgtatgtgtgagtgcatgtgtgtggagtgtgtgtgcgtgtgctcagggcctatgggcctggctccttcagtagagtcacaatccagttcctgctgtgactgcttccctcccgtttcttggggcctgatgacttggattcttccatttttctcacacttcctcattccctccatctccctggtgccttccctctgtgcacacacatattcatgtctttctccgaccctgtgggttatagagacccgtccatgtacctgctcctggattcgagttctctattcagttttcaccgtcagcctcctcagacagcagcttgctccactgacctccgcctcctcaccattgcacacgtcctcccctttcccactcagacgctggcctcttcctcccctcggagcagccttatctgtgcctctcatgactcactggccccagacctgtggcctttcctcttatctctttactcttgacttttttgcatcatttgaaccatggatggcccttgaatttttcttctttttctgcatcctgactttatacctgcttctcgaccttccaggcagcttcctgtgtgccctcttccatttctaagttctgccattcccaaaattgttccaggactgtttgcccccatctcctgttttctcctggggcccttatgtgtgcccaagtcttccagatggtggaatgtgggtgagttcacatctcctgctctagccctggaaccatccacaggtcaggctccgggtttccatctttctgttgggcatctccagtttctcctggctgatgtgatccagcaccagagggagagacagggaggttgtgccaccatcatggcaacaaggaccacctcgtgtttccccaaaccaccccctcccaagacctcctcattgctgtcaaggtgcagaccttcttcttggccttcaagtctcagtgtcatctttgacccttgctcctagtgcctcctgctccaacacatttccatagcccccaagtctttcttaacagccatgaaagctccacccctttcttgcccctgcctttccctcttggtttgtacttccgcttccttcttgacctcccctaatagtgcctagccagtatccttgcagccctgtgcgctccatccccatctttcattttcctgcttcccccgccaccttgcacacctcttgcaggccctttgcctgtattgacattcctgattgaatgaatggcgggtcctttgtgtcaaggacccaggcgcataatgctgagtctccttggcctgacaatcagggtccatccagcccacgaccccacagttcctccccgctgtcccccagtgcttgttctgtggggccttcttacccctccagaccctgaggacctattaccatttcactcatccatccatccatttacgaggggacatggtgcttcccctcgtccatctctgcaaccccaacagcctctcacccctttccccacccattcatttcatctccactgttccatgtctacctactctccctttaaagggcggcaaggaggggaagtggtcttctctgcattgtccacaggcatccagcccagggactgcctcagcccctcccttccattaaacaaaataagcaaatcttgattatttaaatttattttgtttatttattttgttttatttatttgttttttattttttattgttattattttttgagatggagtctcactctgtcacccaggctggagtgcagtggcacgatcttggctcactgcaacctctgcctcctgggttcaagcaattcttctgtcgcagcctcccgagtagctgagactacaggagcatgccaccatgcctggctacattttgtaattttagtagagctgcagtttcatcacattggttaggctggtcttgaactcctgaccttaggtgatctgcccactttggcttcccaaagtgctgggattacaggcgtgagccactgcacccagccaattaaaaatatatatatttttttgagatggagtcttgctctgttacccaggctggagtgcagtggcacgatctctgcttattgtaacctctgcctccctggttctagtaattcttctgcctcagcctcccaagtagctaggattacagacatgcaccaccaggcccggctaatttttgtatttttagtagagctgggctttcaccatgttgcccaggcttgtcctgaactcctgatctcaggtgatctgcccacctcggcctcccaaagtgctgggattacaggtagaagccaccgcacctggccagcctattttatttaaacctcattctgttctttaacttggagcaccacagggcaggggccatatgtcaaaaacctctgtggcttctgtggggccaggattggtacctggcatggattagttccgtaataaatatctgtcctttcctgtttggtttgtgacatggatttccctttgttgacaatgtggggctctctagccaatggaggggatggaggctctattaccatttcagtcatccatctgtccgtttactcacctaaaagctgttaagcacctactatgtgccaggtgcataggtcacaatctgtgtgctccagccaggaagtcatcaaggtgaagttcagagaggtgggtgcgtaggcgaaggctgcctgtcatgttggtgacccaggagaaagagatctgaatcatgccaggcagacttctcagggcaggatgagggcacacttgcgagatggagatggaggtggaagagggagagacggaaggaggagtgagcccctgcatccttgcgtgacagcctgcggggtgggggtgaagggcctgtgtgccaactgagaagtgggagcttcatcctcctgtaaggaggtgccaccaaaggctttcgggtgtgaaagtggcatctgctgtgacttagaaaggccatgttggcaacctcagagtggcatggaccgtgtagatggaggtggggctgctgcaggaatccggggagaaggcaaagggtggctgagcagggcagaggcagggagtctgtgggctgaggatgcagaggtgggggcggggcgggatgaatggcagggctaagccacggggtagatgtgggctgaagatgggggagctgagaccatgccggggttcctggcttcagccactggacagatactggcacccttcttggagacagggcataggagaagaggcaggtgctggggacagtgctgaggccactcttggacatgcttagacgtttgggttggagccgggaggggctcttgctggaaacagggctttgctgctcctgctccacccacctccttggggcctgcggaggagcctgagcggtggtgggttttctgtgaggttcgcacagggtggggcggggctgccacgtgcaggaaggcaggggccctgatcggcatggcctgtcttggcctcagtcctttctgctgtggggtcgctagagaaggggagggcaagaggcttccccagggtccacagcttaagagaagctgcgccaagtcctctgaggccaaatcccttgctcagagcaggtgtgtgtgtgtgtgtgtgtgtgtgtgttgggggggcgcagagcgggggaggctgcagctcagggccccaggggcaaagccgaggcataagcattggggtttttggcatcctgtgctcacctcaggcagcctgggacctccatgagctcatagaagccaagggcaactgtgtggactttgatgctccacttcccctccccgcccgcctccaatcctcttagtgccgttgggcagtggttaagcagtggtgggttacaatggcaaaggcctagtgggcgagctccccaggtcaggggtgccctggagcattcgcttactatctccagcccacacgatccctccctgtgggtccagacccaagaggctgggcctggccctgggagcaatggcgaatcccggctgatctacgcccaggttgaagctccgctcctcctgtggactcccctgacctccacagtccccaaggatcagggttcccctgcatccaggcaggcactgaggggggctgtcctaccgcccctcctgcagcccggcctggactgtgatcctctgaggccagtgtgtgggatattgtgttcctgacctgttgctgtggcttgttactctgtcagccccccagtgggtcctgatgtccaccgagaagggaaagccatgtaggacgctgcagggctggtctccatgggaacctgagctcccggagggcggggagtgtcatgtcttattgatgctccattcccagtgtctagaatagtgcttgacacatagtaggtcttcagtaaatatctgttgaataagtaaatggtgcttccaacttaagaaattacaattaaaaccagtgccagggatgccactgtcttccccctcctgtgggtaattgggattgagcttctggtacaaaacagtggtgacttcctgccacagcaaaggggatcagctccgccccccaggccctgggatggggattacaatcacgagtgggactatttaggggtcactgagctctcacggggttggggcagcttggagaacttgagctcagtgctgtctaagctgggaggcagtttacccttgtttactgcagctgctgtcaactccacaggcccaagcagcacagcgggagggtgggggcttcctttaagtcagcagtttctgtgtgggtgtcagcctcctggggaatgcgcgagctgcactgccaggaaatggggctgaacctggcctggtggtcagcctgcccttgtgtttgcagagggagctgtatctcctgcagcttgaatcctgggccaagagcctctgcagggataacagtgccgtcccctctgtcccccatctcggccattgccccatcctggagccaccctgggctcccccagcagtgtctctggctggccatccctcatgatgcttttctctcccccgttcttttaagattggctcgggggagtgggcctcgggagaagacccctgcatctctgggtacgtatcttccatgcacacctccctttgttatttgactctctacattcctgggctgggtcagggaaacagaattagggccagaggagatctgagagctcttgtgtctgggcccttcatttcacagcaggaagctgaagtcaccggaggtctaaccggagggtggcagcgggcccgggcgaggtgtggaagagaagtgacatttattgacacctgctctggtacgtcaggtgtgatgacgtacaccagcttgtgcagcttgccacggcctcgataagagagacaattctggccgtgtgtgacagacgagctggcacacgaaggctctgtgagcaggatgtcctccctggtcgctgagccccatcaggcttgcagccaagtttccacggctccaaagctggggtcttgacacatcaagcagctgccccttgcggtgtgttaagcaagtagagagagtattcctcacctagagaatgagagggtaaaccagagcccacaaacctcagccagctggccccaggagctttagctgtcaggatatagggccagcacaggattgaggcgaggagaggggacagggcagggtaggaggcctttaaagagggaggagggatccttcctggattgaactctatggggaggtgggacgggtggatggaagctgagcctctgctgcagggttggggagcagaacaccccgaacccaggccagggtggggaggagttggaggcagccgctctactgcccggcaggaggggtggcctccccaggaccagcttcctggcaggtcactctgctaatcagctcagctggtggggcagttggcgaaggggggtggctgttgcccaagaggccctgggatcaagacacaaagctggacctggcacaagaaacctctgcggcagctgcttctcccctgctcccgggccaggctgcagcagggtgagctcaggcagtctgtggcgaaatgcaccggcaccctgagtgaccttaagagctaacccggaggacgctggtgtgggggttgggccaggagaccccagtcagtaaccacttcctcccctggctctccagcttgctgcttgagaaccaggtcaccagggacctgtggcaggggcaggctgctcagacagggctttccagggcatccctttggggtggaggtgaagaagtgacataaaaaatagttaagtccttaaagggctctctgccctccagctggcaactgggctgacactgccctctgtgtgcaacatgcctagcacatggtaggggctcacagggtcttgtctgaagctgggggcttcctcacatctgtggcattcctgcagtccttgccctggccaggtggtgcctaccacatgtgccctctgctctgcctcttacctctgggcagatgaggcttcaaagcccctcttcccccttggcccttgatccttctccctgcaccaagcagaggaatcctttgcagaagacatggcctgggcagaggacctgggtgacctgggagctctgcacgggccccagaggtaagatgccttttccagcctcaggcagcctcagctggtggccccatctcagcagacccctgacttgcaggttcacccaaggacagtgagctccaaaccctgtgggtggcagaaaatgaatgaacctgtttgagccctgccttcataatgagaaatgtacctttaaaatccgctgatggggaagatatgaatgacaaagcaatactgtggatttgatgccatcaagtggaagtgaacgggtattttatccatcccaagagcattcgaaggttactggctgtattagtcagggttctccagagggacagaactagtaggatatatgtctgtatataaaggagtttattagggagaattggctcacacgattacaaggtgaagtcccacaggcggccatctgcaagctggggaagagagaggctggtagtggctcagtccaagttcgaaagcctcaaaccagggacgccaacagtgcagccttcagtctgtgaccaaaagtccgagagcccctggcaagccactggtgcaagtctcagagtccaaaggccaaagaacctggagtctgatgtttaagggcaggaggagtagaaggaagcgtccagcaggggagaaagcaggcagccagaagacccggcaagcaaggtgatcccaccttcttccacctgcttagttctagctgcgatggcagctagcagctgattggatggtgcccacccacactgaggatgggtcctcctctcccagtccactgactcaaaggtcgatctcctctggcagctccttcacagacacacccagaaacaatacttgaccagctatgtaagcatccaatccagatggcacctaacattaaccatcacactggctctcagcttttccgtctgtgaaatgagactggactagtgttagatctctggtcctggcaactctgccctttcctgctgcgtcatgctttcaggcaagcccatggtcatatgaaaggattggtgggcccattttgctttttcttttcctgccgtacgtacctcccaggacagatacacttacttatattctcaggaaatgtcttacatctcctggataacacatctggccctgtttcccgcccagcctccccaatcccacacctatcttggaataaagtgtgcagtgaatgaacgaatggagggtgatgctggtccacaggtagtctgtctcatgcctgccagtgctgccctgtacagtaaacctaactcaggtcttgctccattgaggaagaattgagggtgtggggcttagcagtagaattgagccagccacagggtcagtgagctcagcagtgacctgggtgtcttcagctccacccctgttctcaacccctcagagccaaaacctttggcctcacccatcagagacaggcctgccgctgccaagaagcctgccctgcctttttctcagtctgctcccacgctgacagccttctcctttgactgtgccagagaagcctgccctccgctgaaagaagaggaccagaaggagatcggcaccaaggtacctggggagcgggaggaggaggaagtggggctggagtggaccgcaggctgcaggaaggcaagcaagtgtctgaagtattcaagagtgggaccagccacagagcagagcaaggagagcccgaggcagccacccaagtactaaaggccagaacctgcagacggggttggggtgaaggctgaagaaaggaagagaaaggatgggggtcagaagcggggtggggaactaggtgcagggaagactgcagagggttgctgaaggggtaggagggaggaaggaaggaggacggggaggttgcacagggctcacgaggaagccggacgtggggagagagcaggaagccttaggtgaactgcgctgcgtggtttgaactaacacccaagatagcaaatgagaggcagctgactcagggctgatcagccacgggctgtgctccagggactggcgaatacctcacacttctcaggtgaccttggaaggtggtctcttccctggttggaacgaatttagtgaagcttggggagtcactgtagtgaggagcctgtgctcattctttgagacagaacattccaggtcaagaagcatatcttgaaggcctcctgggtgcatattctctgttagagactgggtgactgttaaatcagcaccacaaccctcccactgtagagaggaccacagaacaggaaacacaaacaatgattcagtgcagcgaaacgagctgatcctccaccccacttctgcgctccctcctgtggccacatcgtaggccttggcattctaaagtgtgtccccccaccatggtctcaatttcaagcatcccattggctcaccaccttctcctgctgttctgctcaatccagctaatccttcagttccaacacttgttccctctctggcatcaacaatattctccttgaaacaggatcattgctatcagcatgttagctctctgttacctctttcattttaagaaagcggaacaaaaccaagagaaaatgattgccgtgtctctcttctctcctttgtccactcctgacaggcattagtccacactccccactgaaactgcccacattggagttgccaatgaccttcatcttcccaaatgcagccacggttagtccttgtctaccttgaccccatcgcagcttttgatacgacttgtgtctcatccttgaattctccagccagggataggggtgaggggtggctcttttttggtcctgcctacgtgaaaggcagctccttcccagcccttcttggctgcctcctcctcatctccccggcctctggatgctggaactcccccagcgctcagccctctggcctctcgtctatttatactgacccgctaggtcctcatccagtccagacattaagtaccatctctatgctgaggactcccacacctccctcgccagcctagaccttcccttgacctccagactaacatgtttagctgctgctcaatatctctgcttaagtgcctaattatacttccaactgactgtgtctaaaactcaacccttgaatgctcacctcagaaaacctcctctctccccaggggcccactcaactccagccttccagtggctcaggtcaaccacctcgggcgtccttggctcctctcttcctctctcgccccgcacctcatatatcagcgaagagagtgagctgcacctgagaagcatgtccagaatctgcccaccccaccatccccatcgccgtccaagccccaccacctcttgattggatgttcagctgcctcctaaacactcttcctgcttccagtgtgaggctagctccagacccttcccgtgcagcagctggcatgagccttagagaaatggaagttagaacgttctgtggatgtggaagatattatcactggggaagggtgaagggaacacaggaagtcttggttctattttgacaacttacgagttgttcttgcgtcttaaactatttcaaaataaaaaattataaaaaacaacacttagagacagcccccaccagtggaaggcagatcatgtcactcctctgctcaaaaccttaaacggcttcctgtgtccttcagaggagaagcccagtcctttccttggcccgggtgatgtggatcctgccccctgcctgatcttgtgtcctgtcacttctctgactcagagagttcagccagtgtccaccccctgactgtccccaaccagccaagcacacccggcctcagagcttttgcactcactccctctgcttcaaacacttctctcctagaaatctgtggggctggtctccttcctttatttctgtctccacttaagcttcacctcctcggggagtccctagggaccttctaggctaaaagccactatcatctctgtctccttacttttctttcagcacatactgcctgatatcagcatttggtctgtttgttgtctctcccccacacttcaaagctcttaaggtgcaaggagtttgtcttttttgttcacttccaggacagcaattggcacacagtagaaacatttttgatgattgaatgttgatgattgaatgaatgggaggttaatagagtttgccttgaccttgtgccagatccaagtcaccatctccaagtctgcccgggagaagatgcagctgaagcagatgaaggagatggagctgcttcggaggctggaggagcccaggacagggcaggagctcacttcccagtgcctgggctcccagagagccttcatgaaggaaggtactgggtgcctggtgtgggatttgctcaggcctggggagctgagtccactctctcatagcctgctgatgggcccattttcttttttaaaatttttattagtatttatgtatttatttagagatggagcctcactctgtggcccaggctaaagggcagtgacacaatcacagctcaccacagcctcaaactcttgggctcaagggatcctcccacctcagcctcccaagtagtgggaaatacagacgtgtgctaccatgcttggctaatttcttttaaattttctgtagagatgggcatctccctatgttgcccaggctggtcttgaactcctggcctcaagccatcctcctacctcggactcccaacatgttgggggtactggcatgagctactttggccagccatgggtccattttcaaaggaggacattgaggccaggggaaaacagacctgcctagtcctaggactttctctgtgtccacaggcctccttcccctccggggcagcgggacactgtctgtgcccactaggctgagcggcccatgcagaaacgacgtcagcatcatcctgaggaagtgggccagccgggcctccctgcccagcatccccatcagccggcaggagccccgctttgcccgccacgcctcaggtgggcaggcccgactggcaggcacacgtgtccctctgcccatgctgcctcaggatgccctgaggcatggcagaggtgacctcggtggctttgcttccgccccttgtccatgttagaccaggaggcagcctggggtggtggttgccttgccagagagagaaacagtgtcagggactcatcattgtctacaggctgggcttgggacccaggatgtcacaactggagttgtgatgtcctcagcctgtgtgacatgtccggaggagtgaccagtgcacgagggccaaagacactagacaatagcacccaaggaagcagctgtgaacagcagaaagaggatgagaggattggggaagacctcggtttctttcctgttgcttcataaaatgtcagggctggacagcactggctacagacaggaatcagagggtccagagcttctaccagggcacctcaggaatcgtgcctgggacatggggacgctctgtccccattctaccagaggagcttctatgttgcctcattttttttttttgtatactgggcattcatgtgagatttcatttggaaagattttgctactgaaaaaaacttaaaaacagtcagcttggttcagagtttctgtaagtgtgggatgtgatggtaaatgatcatggactagagcataatttccatgctgtaaataatgccagctcatctcccttttcaatcctctttctatcctttcaattgtctcaagtagaaagtctgaatttggtgctagtctttagcacctctttttttatttttattattttttataaagaaaagaggtttaattggttcatagttccacaggctgtacaggaaccatagttgcttctgctgctggggaggcctcaggaaacttgcaatcatggtggcacctctctctttaaacaaggagatcctctttcaggctcaaagacagaagctgcctacaaattttttagctagagttttaacattgttttactttcattgtaaatatttatcatattctatgacaaacaatgttagtttatggtagtgacagaaagttccctttaaagttaaattctttaggatttgaaattcttttgtgatttgaagtgcaatgtaaatgaaaggacaggctattgagagatatggcaaaaatcatgaaagtggtaattgaataatatgattgatactgagaactattgatgtatataacccaactgactctttttttttttttttttttttatgacagagtctcactctgtcgcccaggctggagtgcagtggtgcgatctctgctcactgcaacctctgcctcctgggttcaagtgatcttgcctcagcctcctgagtagctgggtgcatgccaccatggcccgattaatttctgtattttagtagagatggggtttcaccatattggccaggctggtctcgaactctcgacctcaagtgattcgcccacctcagcctcccaaattgctgggattacaggtgtgagccaccatgcctggccaacccactcattttatagcagcagaactgagacctagtgatgtaaaagccacccaagatcactcaaggtcatggtgccccatagtaccaccatctaaagatcactagactgagactttggctagtgatgcttgacccaggatagtctgttgtccctctttatttgaactgtttatgtttggcaggtgagcgggtaggtagaaataaaatcaagtaggttatgttgttggagttaggaaaaaaagccaacattctcctcttacaaccatcctggaagctgtatttgaatcctcctcttcttcctctctcctcacagtgaacaaataatcccttaacttgctgtatagtttgggtttttagtttggctggaaatgatagtatttcaggattgtaaacctgcttgtcctcctgattctcctaatatgtcctgtgagagtgttggaaataagagctaggagtcacaaagaaaacgagcactcaaataaaggatttctcagcgaggcaaatttacttccgcagaaggctgctgctcattcttctggtcactgcgagagcacacccaacaaaggagggaaggggtttttatccctaatgcagtcagtccctactactgtgtccggtccccattggctggggttggacagcacaatctaagctgatcccgactggctacttcaaatggatcaggggctctagcggtgggaagagcagttttggaactaagggcctcaaataaggaacagatgtgggttgttacagattgggaactgatgtgggttacagattgggaatggatgtgggttacagattgggagtggctggaaagttgtttattgtaactaggggcaaggaggcaaggaagttaagctttgaaaatagaggacaagcgggacctttgaagaggaactcactgtttccaacaaggagctggcctttcttgggagactgggttagtttaggtgagctcagctcaggatctgttcaacttcttctgttgtgtgtgtgaaaaatagaaatgactgaaccagaaggcacaaatacgaacatgactggaaagctgtcagaggtagggcaaagggggaggccacacaagccctcaagacactggaggctggaatccccctgccagtgccttttgtgggtttgtttttaaatccagtggatgctaaatgcccctgtggggtgcggtgaaggcgaggaaggggggcagcagggcaggtggctgtattgctcgctccagaagactgagcctctttttgagagcgttgcagacagcatgtcattcacgtccgtgctgcccagggaaggatggggaggttggatattacctcctgcctttcagagagtgactgaaataactgattaagagactgttccacctgccaagggcagtgctgaaaaagagtccaagagtgagggctttgtgtctccgctttttttgtttgtttgtttttttaatccctgagactgagtctcactctgtcgcccaggctggagtgcagtgacatgatctcggctcactgcaacctacgcttcccgagttcaagcgattctcctgcctcagcctcccgagtatctgggattacaggcatgtaccactatgcccagctaatttttgtatttttagtaaagacagggtttcaccatgttgggcaggctggtcttgaactcctgatctcaggtgatctgcctgccttggcctcccaaagtgctgggattacagatgtgagccactgtgcccggctgtgcgtccactttcagtaaagggcttcctctccactcagacttgcctaggacctccagatgtactgtggtgaaaatcatcctggtggaggtgaagctcgggagaaaactcgccaggaaggaagatgtggtagtgagagctctggactgggagggggatcttcttgtcctggctgtgctgacagaggagccgaggggctgtggagggtcccccaccctctctgggcctctgggacctcaactgtgtgatcagggcatttggctagacagaggccctgtaagactccttcctgtcctaggagtttatgatttcagcatctgtctcctgggaaggagagcctagaaaacacgacaacctgtttgttgtgggtccctgtgtgtgtggctgcatctggactgtgtgggtgccagttagctacattgtcttcctctagccatctgctcttggactcttccctgcttgtgggcaacctcacaaaaggctggatagcaagagggaaggaagaggcgctgaccatacaggcctctggttgggaatgaggttagaccgccaccaaagtgagtagggagatcattcattgatggctcagggggccccaccccaccacagatggggcaggtttggaggtgtccccctgactggggggtttagtcccatgacatcatgtggcttatcacaaatctgtttataagaatcgcattggcaagggcaggaaggggaaaagtcagccaaaggtagagttaggaggtcttcatggctcctggggagggaggcccaggcgctgggttcttagcctcaccaggcacttccacttgtacaccctccctgttaggtgggctcagggtggtggcacggcctcccatggtgagcggtggcaggagcggccactcgggctcttgcctgtcctgctgcgtgaagcctgctgtttctttcttgtgaatgcagctaactcattacctgcggtgctcacgttggggtctcctgaatgggaagaagaggaggagatggatcttagagcctgtaaggagttgaggcctttctcgaacccggagctggggctgagggatgcactccagtgcctcaacagcagtgactggtgaggagatgcttccaccacgtgctgtgttctggccggaagcaggggctgttgcagaatagcttctgcccctcaacttccctcctctcccactctggggttccagcaccatggagcataaaagccagtttggagggaggactgtgcatgcatatagatatgtgtgtttatgtgcgtgtgtgcatgagtgtgtggtgttcctggctttatgtgtgtgccctgcgaccctccaagcagcctatgcatggctctgtggtgtaccaaagccaggcatggcaaggatgcatttgattccacaccatggggcccaggaaggccgcagccctttatttctctgaatgaaattgaatctgctccgagcgctcctcccactgtggggatgcaggaccgtagtcatgagcaaagcaatgcctcggcctccagaacatttgtgagaagccctccctgccttcagtcctccctgttcaagtgccttttattgaaggtgttggctttgtgtcaaggacccagacaggtcctggaggggggtgggcttccatacagcactgtcagagctgagggctggccagaggccacataaaactggcttttactgagtggttaggattccaggccagggtgttaccccgggaaaccctgctctgaggccatggaatggcaccctgctgcgggtgacggtggaccgtgatggtgtgtgatgtggggcccctagtctgcagaggggtggggctcctccctctccacccttctgcaacagggcctggccttgcttctcaggcagatgaaggagaagggtctggtgagcatccagcgcttggcagcctgtcactcagaggtcctcaccgggaagctgcacgacgtgtgcttggtggtgactggggaggtgaggccccccagcctgtgtgctgtgcatttggccccactgcagctgctggatgcagtccgctagcagctgtggaggggctgtggcttcagggacatggggatccctgcttatttctcagccttcagccactgaggtaggaggtagccacccatttctcagattggaaaactgaggcctagggtttccttatttgtaatctttgagaatggaaacaattagaatcccacatgcccatgtgtcggcctgcatggtcctctgtactcaaaatgcctaaggagggatggagcgtccagggccagatccccaactccagggcagtggtagtatttcccaaagcgtttctttcatggctctgtggcttggtctagctgggtccagagaggcaggaggctacatttgttctcatgtggaggctgtgccctgcccttgggagtgggctgctccagtgggggtggggtggggatgaatacggaggacgctgttttgttaacacaggggcctgggctgtgtggggagcatctgccttcctgcatgtggcctggggtctctgtttcctctgcaaagtgaggcatccagaaaaaatacagttacattctcccaggttaattagagcctcagtcagcactactgtgcttctcatggtacctatttctcacttggtagttgcaaagatcaaatcagacattctttgtaaaagtgctttgaagacagagtgtacacatttcctatggtcatgataatgatgggattaataattgagatgataacaaaatgggacagttttgctcagagtggctgcagggtttttgtttccagcgtggcaaggcctaggtcaggggaagggtgggggtggaggaagagggtggtgcagggcccattttccatgcgtcccagagcccttggcagggtccagcaccctggagggcctctctcctctctccaaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtctagtatgtggctgcctgttgtctgaggggcggggaagtcagggaaggtaaggcaaggggagaggccctgggatgtgaaagaaggagggaagggtgcagggagggagggagggaagcaggcaagtgaggctgcagggggtcccttgagatgctagaggacagggtgatgggtcagaggttctgagtgaagaaggggcccatctcagacttcacagcaggtgcttcccacttagctgggggaggaagacccctgcttccctgtgccgggcatccggcttctctcccaacctttcatcggccaggccgggggaatgcagggacctctggctggaagaggagggggccgttgcactccaaggctggggagcacaccgtggctgtgggagcgccccgggagacagggctgcagaggcagcctgagcatgggccctggagctcctgtcacccccaggagcagtgttgctttctgatgaaatgtgggccagtgagaagagaaagtcgcaaaatttcattctccagcttgccccactggacctgctcctggggaggggaaggtattgggttcctgttggagcctttctgcagatttgttttccctgtcattaaacacccacactaaaagcaaaaccaaaagcatttcccaagctgcttctcccgcacagcaaaaggcctctccaccccataagtggatcattacactgatgcgtgaggtttctcagtagccccaggggcctgttggaccagctgggagacctttagtaattgcaccatagcatactgcaaagggtgagatcctgcccagccacattgcctgggttcacatcctgattgtcacttcacttctctgtgtctcagttgactcatctgtaaaatggagataataatggtgtctacctcatgaggttgttatgagaggtaattgaattgactcacgaaagcgcacttagaaaggtgcctgcccattcctgacattcactgagtgcttactgtgtctataattaacttaggagaaatgaattgtattttttttttctggatgcctccctttggctcagcttcctcacctgcagaatagtgatgataatagtagctaatgaggtagatgtgagataatggataaaaggtgctggcatggagggacaggcaattgatcactgtcaacaagaaccagggtcatggcttgtgcatctgagtccgctgggatcttgctgaaatgcagattctggttcagatgtcagtgctgctggtccatggaccatgctgagtagggagagttctgatgtcccccactgtgttccactggggtgagactctaggggacaaaagggtcagtgcttcctgatggagtgtggacacagaggcccttagaaagaggtgccattctgacaggtttctcttatagagctcaggttccacttgttatggtcaccaactcacccatgaatccctcttctccctcctgtctcagttcagttcagcaaacatgcattaagctcctgccaagcaccagggatgtgtcaggcacagcagggcagtggggttgccacagagagggaatcaggactccagccaggacactaggtagggaagcaccaggggcctggggcggagaaggcaaccagccagccccgaggggcctggaacatgcagctcagcttccctgggattctgcagagggacaggcaggtggatgaaagctatgtccttcagctctagtcccatcccttccgtcaagccaagcccattcagcaaggagtccttactccctgcctccactttcttgccttccatttcccctctgcccatcgagtgttgctcttgtttctgcctcaccccagtactgttctctgtacattcaggccttttttttctggagatacttaatgatcactcttttcgtcattatggatacagcagtgaaaaagaaaaatgaagcccctgttgttttggagttacttcctagtcaagggagacagataacctggtccccgcccacagggagctggcagcctgatgggggccctaagggtgcaactgtacttccccggggacaaagacagcgctaccttgggcagtgggtgggatgtctaattctgcctgtggggctggggaaagaaggaagaagagacactggttaggtaggacttttctaggtggagggaagatggagaagagtacttagacaaaaggaaggatgtgtgtgcaggaagctcccaagaacggtatgcatacggtgtattggggaacctcgtgtagcttcatgtcactttccttccctctcccgttgttgctgtcaccctgttcgtagaaagtgagtgctctttcctcaaagattcccctcagctcacatggggacaggtatttttggagcccctggctggcatgaagcatgggtctgcaatggtagatccatgtttgccagcctggggactcccacaccactatcctgagactgacccctgggccatgatttcctttcagccaccggaaccccttgatccggaaatacgcggctgagcacctctcagctgtgctggagcagatcggcgctgagaagcttctctcgggcaccagagacagcacagacatgttggtgcacaacctggtgaggctggcacaggactccaaccaggacaccaggtagggcagggccaggggcctgggggcagagaaggcaaccaaccagccagccctgaggggcctggggcacacagcttcagcttccctgggatcctgcagagggacaggcaggtaggcggaagctatgtcctttcctttcagctcttgtcccatcccttccatcaagccaagcccattcagggaggggtccttactccctgcctccactttctggtcttccatttcccctcttacccattgagtgttgctcttgtttctacctcaccgcagcaccattctctgtaagaacattcaggcctttttttctggagatatttaatgatcactctttttcttattaaggacacagcagtgaataagaaaaatgaagtccctattgtattggagcttacttcctagtcgagggagacagataataaataaataattatggtaattttagatacatatcagggatataaagaaaaaataggccggatgtggttgttcatacctgtaatcccagcactttgggaggccaaggcaggaggattgcttgaggccaggagttgagactgggcaacatagtaagatcctgtctctacttaaaaaaaaaaaaaatgctaggggtggtgttgcacacttgtagtcccagctactgaggggctgaggtgggaggatctcttgagcccaggaggtaaaggctgcaatgcaatggagttggtgggggggctgctttagactgagggttcagagaaccttttttaagagtgacatttgagttgagagctgaacggctacacggagccagctctttgaggatcaggcaaagcaaatgtcacagaggccactggatgggaacaagcttggtgtccaagggtggggacggccagcctggtggagcacagtgagtgaggggtgggggtgagggtgggcagcaggcccaggtcagagacgttctcctaggccaaggtcaggagttgggattttggatggtgtgtgattggaagtcattggagtgttttcttagtgggagtatgaggaggtgttggaggattttaagcaggagagcgagaggatctggttgactgtcttcaaaagctagggctggagcccagttcctcacactcctcagttcagggcttattactaccacatccatttggatgagtgtgtaggtctccacccctcactccatcctcgccccaactggagaccatgtggcacctgtcagggctccagaggccatgcccaccctggatgggtgagctccaggccagacattctcgtagggtacccacgtctgagggtgctccctgagggatgtagtgcctgcggttcctcccattctcccctgctgcaaactgtgctgcatggcacctcctcggacgtgcccaggagcaggaccgtgggtcagatgcatgtgtgtgctccagcagccccgccctgcctggggtccacatctgcctccctcctgcacagcctctcagcatgtggcaatttctagatttctaatttttatccatctaatgggtaaaaatgatagctcatcattgttttagagtgctttgaccccctgcttattaataatgagtttgagtgtttctttacatgcgtgttagcctttataattaaaaaaaaaagcctctctggctgccgcaggactggtagtgagagagaaaggcaggaggaacagcagatgatggctgccccacagtccaggcaagaggggctggaggctcagactggagagtggtgggtggcttcggccaacagccaacaggatggcagagccaacaggatgcaggtggtaagggtttcaaagacgaactgaagatgctcttaagtttttaccctgaacaatggtgaataatagtgccatttgctgaaatgaggaatatcagtggagaagtggaaggttttgcttactcctgcaagaatggccataatcaaaaaaccaaaaaataatagatgttggcgtggatgtggtgaaagggaacacttctacactgctggtgggaatgcaaactagcacagccactgtggaaaacagtgtggagattccttaaagaagtaaaggtagaactaccattcgatcctgcaatcccactactgggtatccattgggtatcatcatatgaaaaagatacttgttcacgcatgtttatagcagcacaattctcagctgcaaaaatgcgaaaacagcccaaatgcctcatcatcaatcaacgagtggctaaagaaactgtgatatgtatgtatgtatgtgtgtatacacacacacacacacacacacacacacacacactggaatacttagtcataaataggaatgaattaatggcatttgcagtgacctggatgagattggagactattactctaagtgaaataactcaggaatggaaaaccaaacatcgtatgttgtcactcataagtgggagctaagctatgaggatgcaagggcataagaatgacataatgggccgggtgcggtggctcacgcctgtaatcccagcactttgggaggccgaggctggcagatcacaaggtcaggagatcgagaccatcctggctaatacggtgaaaccccgtctctactaaaaatacaaaaaattagccaggtgtggtggcgggtgcctgtagtcccagctactcaggaggctgaggcaggagaatggcgtgaacccgggaggcggagcttgcagtgaaccgagatcgcgccactgcactccagcctgggcgacagaacaaggctctgtctaaaaaaaaaaaaagaatgacataatggactttagggactcaggaggaactagtggcaagggggtgagggatgaaaggctgcaaatagggttcaatgtatactgctcgggtgatgggtgcaccaaaatctcacgaatcactactaaagaacttactcatggaaccaaccaccacctgttccccaatgacctatggaaataaaaaattaaaacaaaaacaggcaaacaaaacattgcctggctgggtgcagtggctcacatctgtaattccagcactttgggaacccaaggcaggtggatctcttaagcccaggagtttgagatcagcctgggcaacacagtgaaatcctgtctctacaaaaaataccaaaatattagccgggcatggtagcacgtgcctgtggtcccagctacttgagaggctgagataagaggatcgcttgaggccaggaggcactggttgcggtgagctgaaatagggccattacactcccgcctgggcaacagggtgagaccctgtctcaaaaaaataaataaataaaaaaatcacaaatcacatagccattaaacttggagcaaatactttgaagagtgagtttagggggactggaagaatgggatgaaatgtctataaacagctattctttgtgtagcatctactagagcatctactatataataaagtgttgtgtaactctgccatgcaacgaaaaaaaaaaggacgtagaaggttttggtttgcttgttggttttaaatggttgttagagggatggaaatcaaggtctaaagtctctccagatctgctactcctctccattctgacccatcccttacactagatgatggtgactacatttccttttccttcctagaactctgtccttcctggtttccatggcactgtactccggggattctccttgtccctctgtgaccattctgcccctgactgccacctgagtgtaggtgctgccaaggtgtctttagtcctcatctccctctcctggcttttacttctggtggctccagccaccagcaaagttggaggcttctcaattcttgccctccactccagacccttcttcgagcatcagtccccatttctaaagcctccatgggacccaccatctgatgtcctactgccatctgcagtgctgagtgtccctaaatgaactcattgcctcctctccaagtctgcctctctgtgttctctctatcattaaaagtgactgttatttactgagccacccaagaggcacaatggggactcccatacttcattgatttcaagacacacatccttccctggttttaatatttttaaaattggcatgtatcttacaatgacaggcatttcacagttgctgttgggcttcagttgggctaggcagtgattaggacataggtgtttttgtagttttaagagatggggtcttgctatgttgcccaggttggagtgcagtggctattcacaggtgtgatcattgcacactacagccttgaactcctgggctcatgtaatcctcctgactcagcctcccaaatagctgagacaataggtgtgcaccactgtgcccagtttatgatgtagttatactatctgcaccttcacaaacttagtcagtgttgctcagagtattattttctgaattaaattttccattgtaggaactacactatgagcctttctttgtaaatttttaaatttattttcagaagtgatttttggatgctctctggagaatcattgagtttaatctgtttaaagtttcttagaaatattacactattatttgcaattgaaatgaataattattgtatatgagaaaaggcatggcaacgtcagtggatatccattagatatcaatgaagcaaactctcactgtggaaggaatgaccaagtcccacattttttgcaaagcaatcactaagaactttacctgacctaaggaagaaaaataccgacaagcaatgctatcttctgtttctgagatagcacatagaaagattgccctcacacatggggcagtgtcattggaggctatggaaatcaccagtttttatttttctgattttccttagtggaaaataaagtaagggcaccttttacaattaatggagtcttaagtttgaatgaaatatgatttaagattttagatgcttcctgcttcacttcccaccagctaccaaatcctgtggtttccatcttctcagcagctcttggatctgactgtgcttccttatcctcactgtactgcctgatttcaggcctgcaccatctttttcctggactattatggtggcctcctaataagtctcctggcccctagccttgtctccaccaatccatcctccacactgctgctagagacattttgactgatgtacaaattgaatcattcttcagcttcctattgcatgcaaactgaagcctaactccttcatgtctccctaaacagggtcctgtgttctcctctggcctgtctgcttcctgtgtccaacctctgctcactattctccaatatatccccctgctgacatgtcacactgtgttatagacctaaataaccctgttcctccgacgtatcccaaatcccacccaacttgtgaactcctacttatctgttgagccccaacgcaagggtcacctcttctatgaagccctccttgattccctcacctgccaccactgttcatcaggtagattgactacaccctcctatattgtcccgctttaccctttctgggacttctaaatgttccatattagaacaaaattgagtacactttggtatagccattcaacggaatattttgtagccattaaaaaggatgtttatggagagttttaagggacttgggaagatgattaatgaatgataaagtgaaaaagctgaatacaacttgtatatacattctgatatcaactagaaagtaaatgccacagaaaaaagactataggaaaatatgtaaaaatttaatagggattttctcttggtaatgggattatagatgatgtttattttattaatctattttttaactgggtagggattgcttttgtaattagaaaaagtattaaaaactctctttaattaggaagattatgtaaagctgtaaagcaaatttattttgcatttcagaggctgtttctttatcttgctctctctcctgtggcagattttatggccggaagatggtgaatatcttgatggcgaacactaagtttgatgcatttctgaagcaatctctcccatcttacgacttgcagaaggtcatggcggccattaaacagcaggtgagctgtggggcataagtgggtcatggccttttgggggtgggggtgacagtgctgagcctggtagccttcatgtgggtcaggggagtggggagtggattccagagatgttgatttcatccactactcctgataggtgagatagatgtgatttctgtcctctgtgctcacacctggttctaacctcacactacccatgttccttgagcctccctgggcctccatgccttcatctgttaaccagggatcttgatctctgccccagctgctttcagggctctggaaggctcaactgtgacatctgaagctctcctaggtggaagggattattgccattgttatgtctccactggaatgtctggcatttccctggagggccactccttttggctcatgctctgtgtgtattttttcaagggaatagaagataatgatgaacttccctctgccaaaggccgcaaggtgttgaggagtctggtggtgtgtgagaacgggctgcccatcaaggaggggtatggctgctcctgtatctctgggcttcacatctaagacttctgacagaggcatcctgcttgtccatggccaggggtggctctggggtggacatatggatctggggtatcgctgagacctagttggggctgcaatactaatagatgaatttgcaggatgtgttccccccaacccaaatcccagggagaccaaatcctgggcttgggagcatctgccagtagaagttggttcctgcagtcccagctgagtgggcggggttccactagcatcggtggttggactctctgtgtgagctcagtgtttcctcgttcgcttagaccagcagatcctttaaccaccagagtggccagcctgggactagttcagaggcccagcctgaactaaggcagatgagaagacatggactgaggggctgggaggagggggtgtggggttgctgggagcagttagaaaccaagcaggagtctgatggtcacgcctgtgcttaaaactgaagcccttctgtaatgtcctgggctgatcccatctgaactccttagcagggcactagggaagccccatgcccacttcttcaaaggtaacttcctgcctactctcccactcttcctgtctcggcctgaccagagcagcacctgggataagcaaaacatgagagcagctggtattcatgcccctccacatcctctctccctgctgtgcctttgcttatcctagacaccatctgcacctagaacatgtctattggttctgcaagattcagctcacctgtcactttctccaggaagctctaccactctgtgtcctcatgtcctcagggtgacaggctggcctgttcttcatacctctgtcagccccgttgatgtatctatcttcccttggtctgtgagctcctaacggcaaaggctgtgctctcatctcacggttctcagtgcccagcacagctcttggctctcagtagacaatgagtgtggaatgcaggagtgaatcacagaatgagggacagtgggctctgctggatgggacctgggtgtagggcatgagccagtgacccaggcttggagctgaaggtgggagacagtagttctgcacagagctgttcttatgctggctggaaggggctagggggctgtgatgggcatgtgatcccagtgtaagaaaatggggctttttacaatgtccccagttgctgggggagtgtgagcagagcctagccagccagggatcaggatataggagctgggcagaaggttggctgtgatgacctccaaggtctttccccactcttacattaaatgtgcaccagttggccaggtgcagtggctcacacttataattccagcactttgggaggccaaggtgggtggatcatgaggtcaggagtttgagaccggcctggccaacatactgaaaccctgtctctactaaacatacaaaaattagccgggcatggtgacacatgcctgtaatacaagctacttgggaggccgaggcaggagaatcgtttgaacccaggaggtggaggttgcagtgagctgagattgggccattaaactctagcctgggcagcaagagcgagactctgcctcaaaaaaaaaaaaaaaaaaaaatgtgtaccagtcattcttttgtggatagccacttcctcactctgacttcccccattgcttacatatcttctgaaaagagaaaaaggtaggaagagagagccctggcccctgacaaggggatggagccctgggcaacaagctgtaggtggaggggaagctgggggtggactaacctgcaggtgacactcttgtctctgccccacctgcctgtaggaggtggcatgggaccagaagtgggttcattcccccgggctcttccctggggggttcagacgccacgctccttacctaggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcccacctggtccaggtgagcaccgcttgcttttactctcccacctgtctctcctctggggggtgcaacttgaagtttgaaaactctgaatggcgttggacatgtgtcagaccccttgctatgcagttggcctttgtaacatggagactacctggaagtggctgagtgggcaagggcaccgcctcctgccggcagcttggaaatgctcagagatgtctcttgtccttctagcagatttacagtgaggagggtaggaggtagaggtggaggatactgtggtgaggccttgggttgcttctggggagctaggtgcatcatgtttgggggcagagcatgtggctggacaggtgacttggctgtgatggctggacaggtgtgttaggagtaggtacaagcccttcataggctgaacactcaggtgggtgcctgcttcttggtggactgaggctgctgacagtcagttacacagctgagcaaagacacagctcagagtcagcagacctgggtttccatccaagcttcttactagctgtgtgatctcaggcaaatcattgaacctcttggagccccagttgttgttgtttatgggaaagtgggggtgaaaatgtgctccatgggttgttaagatcattcagtaaaaatgattgcacagcaactaacaagacgccctggacacttggcatgcaatgagtgctcaatacctgttggttcctcccctcttcccacccttttgaggtgagctcttcatttttgagagtgctgtggcataggtcagggacgcaggaggagtctctgctgaggtcgctcagttgggccaggtgagctccaagctgcctgcactgtgggagtcctgcccagcctgggttcccatgggctcttggtttctgtttcttcaataggtctttgatgctttcaccccaaggcttcaggattccaacaagaaagtgaaccagtgggcgctggagtccttcgccaagatgatccccctcctcagagagagcttacaccccatgctgctctccatcatcatcactgttgcagacaacctcaactccaagaactcagggatttacgctgctgccgtggctgtgctggatgcgatggttgagagcctgggtgagtgtcccacgtgggcctgtgtggctctggtcaccatgtccaccctcctgcttggaaatctgcaaggtggataaggccttggttggttcccaggccagatgtttcaccagaggctgtgtagggcagaggtggagcccagggcctccaaggctcttggccagtgggcttttctatgtcacagccacccacacctctggacggctggaagtggaggtgatgtggagatgatccagtccagcctcctcatagacacatgagggaaatgaccccccagggtcacaaagcaccccagtgggtgagtcaggagtgctgggaaggcttaagctgggctggggcttggcgtggggtttgtggtgatgggcagggagggaaagtggagggaggggaaaaaggatagaagaaaaaacggtgggagctatggaagagccatcaggaaaggtgagagcttctaggtatgacatcttgcttctggaacgttaagggaaatgttggtgcatctgcttgtgttttcttattcctctcatggatgctaaaaggtgatgtttggtgtacccagtacgtggaccaaagtgcaaattccaaactttaggtgtgtggagaaagtagcacatgagtagacttatggccagcccagtacaaggacgagctttcccaaacaagccttgcttcagtacgaggaagccatggtctgaaaaccacctgtgtttgccttgttgctgtgtgtcctcatgagcatagagcaacgtcttgcctttagcatccaaagaccatcctttagagaggctggacacccctcctgatacacttgctgtccccctccccccgaccccaccccacttcctggcctgagcccagctccctggggctgggacaggcaccgtgtccttggctggaggctccaggaaaagtttcagttacaaatcaaaggcctggtcaggtccctctctgcctcttgagttcataaatattgtcaatttccactcttcatctcagagggaatttatgatttgctgagtttgttgctgtagaacaaacaatataaatccagctctaaattacggcttgttctcagcattgctctgggtaagtgagattgctcttgccaataaccaaggctcttggtaaatcaccatgggccttggatttattgggaaaacctgtaccaagcaaaataggctttagctatttgaagaggataagtacccttgtctagggagaggaatttttaactcttccccctccaggtgttttagtttccactttttgccatcaggccagcctccttgagctctggaattgtggcgctttgggcaaaaaatctagtgtctcatactgtcacaagattcaggtccctcttatttggggccctgttgtacccctactagactgggcatcctggaaaggagagcctgggggtggcctgcttttgtgatctgaactcacctggtagcaggattgtagctactaggaagatgcctatgttctcccttctgggacagggcctccttgggtacggctgataatgtaccctctggttcatcatccagaggctttggtgcaatgggaagggttggctctcttcctctctaatccataggtcagggcttaggctggaatggaatggtgtggccctcaaagggatgaatggagtccagtaaatccctggcaaaaggctcaggtggagcccaaagggtaaaatatactggtttttgtttttgtttttgttttttcgagatggaatttttgctgttgttacccaggctggaatgcaatggcatgatctcagctcattgcaatctctgcctcctaagtagctgggattacaggtgtgtgccaccacgcctggctaattttttgtatttttagtagagatggggtttcagtatgttggccaggctggtcttgaactcctgacctcaggcgatccatctgcctcggcctcccaaagtgctgggattacaggtgtgagccaccgtgtcaggccaaatatgctgttttggatccaggtaatttttgagcaggtgaagcatgggctatctgggcctgatggctttgctgcaagccataccctcttagcccagccagcaaaacaggttttgaaagtgttcctaactttgaagtgaccagctgatttccacatccatgtaggtcagaactggagggagtaggttaccaacaagggggactcattgccagggagtacctagggtagaatctgcctctgggaatggttcttatctgcctgtcatggtctgagcctggcctgcagatggaagtaactaaatttcccgctgtcccaggggattgggtgatagcagcagagagtgcatcaaatcggacggaagagaaggggtatgaagtcttcccaaatcacccaagctgagcctggtggttctagtggtttcttgggggacctttaacacctgaggcccctcttggaagtggcttggatcggacatgatccagtttctttgatgggaaggagcttttccccaaacctccttcttcatgctccataagaaattctgggctccaggctggagacgactgttgaatgctgtgaaatatttaaatgtggaaagtcacaaagcaacagctcagcaggttactgtttatttcctgctaaactggaggtcaaggggatcaagaataatgccaagctaggatgccttctggcataaagtccagatggcacagccaagtcgggaggatggccttcttggggggaccttctagaactcactaattctagaattcagtgataaagaagccagtatcatcgcttctaatcccttggtttccccaggctgggtggggttgaatggagtattggttggcagagcaggtggggatttctgcccatgtccttttcatgggaggtagtaaggaatgagacatgtttgcagcttgctccctgacctctgccatctctcactgccagccttgaggcctctctgggattggggctcaagtggcattcttcctactcagcaccaagaccttctgatttcaggggaattattctgggatcaaggaagttcctgagtagaactggttggctctgtctttgggctcttattgggttagttacagaagaaacttcgctaatgaaaacatcaggctgctgacagctcatcccctcccgatcagacctcagcattcaagcttctctgtgccaaaaggaactttcttaatttactccagcccctggtcagtactggagagggcagataagcttggaatgcgggtggcttcaggtctacttttgctattttgctctctgactttaaatttattaccttatataaatcatatcaacattataatgttaatggaatttaaaaatgcatccatggtgctcctccaatataccaactgcttaaaaatatctcttctatttttgtctatatacaaatttcccttgttaaaaatcataatgtaaatatagttttgattttgcttctttcatttaacactacccagtttcacatgctactgggcagtctttctagttaattagaaaaccgaaagttcacttctaccactgtaaagaagtcatacttattttgaataaatgaagatacaaagcatttgaaaggggaaaaaaatccctcactcatagtcccaactcttcagagaaaccattattaacatttggcatttttttgagttttttcctgtgcacatttgtgtacatggttgttgtagggtaaatccacctgatagcaataactttagcatccccttagaatgatcctgaatggcagacacaatgagtgtgtgttctgagctagggtatctgggagtggccaacttggagattcattccttgtttatgaggcacatctgagctcccgaccttcccttggaacatgagccatacaggggattgaggccctgaattttggggtaaatgaaggttgccaggtggaaggtgttaagtgaaagtgctatgtaaattgcatgctgtttgcaggcagttgcgattttcctgcccagccctccgccactgcgccataaggctctcccattcagcctgctgccactagactctctcccctgtaggtaagcccctaataaaaccccgtgtctcgtttgttggctttgagtctcttttttggcctcttgaaccagatacccttcctattaataggggttaataggggttcagcacagcagttgtggtgttatacatttggattcgcatcctgcttttaaaaaaatcatagcataagcatttgcagatgattatactcttgagtcactttttttttttttttttgagatggagtctggctctgtcacccaggctggagtgcagtggcacaatctgggcgcactgcaacctccgcctcctgggctcaagcgatgcttctgcctcagcctcccgagtagctgggattacaggtgcatgtcaccacacccggccaatttttgtcttttagtagagatggggtttcaccatgttggccaggctagtctcaaactcctgacctcaggtgatctgctcacctcggcctcccaaagtgctgggatgacaggtgtgagccattgcgcccggccttgagtcacttttaacagctccatcacgtgactgcatcataacttgcatgtttctgtgcaagtgaatcagtcacagttttttctttagatgaacatccctagtgctggtagccatggtgaatctggtaaaaccagcgcgtcataacttaccaagtcttgtgcttatttaggggactccagtccgactccagtttccttgctaccatgttttctacgctttcttaaaagctcttatctggcttcccagtagctggaggatgatgtggcctggtagcctcagggcttggctgaatgggacaggtgtaaggccccttagacctccacctcattgtagagaggggagtctgagcctaggaaggacagtctctgggctgcggctagtggctgttttctctccaattcaaggccagtctttgcctccttgtgaggcagaaaaggagcctaggaaagcaccaggttaggctaatggagtgtagattttcagcttttaaaaattagattctagcctcttcattggtctctctaccattgtggttgctgggctctcagagttttaaggtaataatagtaacaataatagctgatacttgcatagtaattatatgctgtaggcattatcctaagcactgtttattcattgaacccttacagcaactttatgagaaagctattagtatcatccccattttatagttgggtaaactgagtcatagagcagataagtggcttgtccaatgttccacagtaaaatatggaagaaccaggattcaaacccaggcaatctgtattcagagctcttacaactgctatgctttagtgtgtcttattgaacctggaggtaacctgaaaggtgagccttcactctaaaagtggccagcggaaagacaggccaaatgcctgggcatagtgctctggggttcataaaccagcccaggcacactgtgtcttgttttgacattgccctgcagctacaagcatttattcagcacctgcagtgtgctgtgcaccgtgggagcatggtctggcacaggtctctgctggatatgcatttttaagtgttccccaaattcacttctttctggctctggggagaggggatgtttggggccagaggcgggagcccctgctgtgtctagatgtcaggtctagatgtgtctagggtcaggttccagctcatgctgaggtctgaagggagtgggtggatgagcagaaagaacactcgggggggctacaggcaggtgaaagatgattttattcagcagcagctctctgcagcagcttactctcacaccatctgccctgtctcagctgcttagtctgttggctcccacacacagctgcgccggctctcccttgccttcagggtcagcagcttaactctttccctctgggcacaagccgtttcctagctccgtgtccgactgccagacgggcattctctcttacagggggcagtagcttcactctctctctgggcacacacaagcctgcacagtgtcagcagggcaattatgccttttacagaccatagtggcacagggccaaggcatggccttcccatgttacgactgtgataacaagtggagttatacgtctgtgctctaaacttgctgagtcactctggatgtttaccttggcctatccttgaccaaagcacagccatgttccttacattagagaatgttctaggctgagcattgtgggaggtgacggaggaagaagtccttgtcttcaaatctgagcccaggtaaatgatggggtgggacaaatagaaacacctggaaacaaacaggtgccattcatatgaaaatctattcttaacgcaattgacagctttaccaatgcaccccgagaccttatcttgctaattactatattctagaagctggcatctcatttatctcccagggcaaattattttaaagccgcttgatttgcggatggagcttttgcaaacagcagagatgtacctgggtacattttctcctctgtatccctcaggaggacagcaagggaagcagggatgagctcttagataaacttgtgcctgatgagaaaaacaaagcactgagtgcccctctccaggaatgcaggggctctgtgctgaggtattgaaggaacttggaaaaagtgagactggaaagacttcctcgtgcagaactctaaaaactctgtcccctgtaaagagaagtctggcctggagaaggtcagctcctgggtcccaggatacacgtgctgggctgctgtggtaacaccacataggccacctgccctcacctacctgacaggtgcaggcaagacacaaagccacatctctgaaaaatgcattttgttacttgcccaacttcctactgaattaagttgtgactagtgtggttgcaaaatgctgggagcttggcatgctggtttctctgcagtccacaaggagaaggttctgatgatggtgtgtatttctcagcttagcacacctttctaggacaggcccatttttctcacgttgtgtgtctttgtgagaaatgcatctcttcaagtttaatagtttgagaaaccaggaggtgtcagctagaatggagaggaacaagcagcttctaaattcagtagatacggagtcctgctgcagtcgacttcgggaatatgaaggagccagacagccaatttattccggaaatgtccccaccccatttgcttgtgttttcaccattagtggctcatctctgtaataaacactcatactatttcagttctttcaagatacaaatggggtggtgctcagtccccagaactttacccatgggcatggctgggcagccagggagctgcgcctcgcagctgggtgtggctggatggttggtggagctgggattgggggcgggcacactgggacaattttttcaaaaaggtttaaaacacctcttttcccaaacctcccgaaaggcatattggggcatatagacgataaactcagccatctttgcaagtacattcatgctgggtctgagactcagaccacctggagtttacaagtaaggagaaaatcaggccagggcagtgaggtcatatataaaccattgatgataatatgtgctcctcagcccacaaactccctcctctgaccctgccagagccagccgggtgcttctgctctggataggatgaccaagcatcctgggttcccgggactcgggactgacagtgctgaaatggggagagcccgggcccaccaggaccagtcagtcaccctggcctcagacctgcaggcttttggttacaagagcacagtgcttctcacctggtgtcagggttcatgtctaagcgtctgtctgcttgtcagaggagcctcttgagggggatgggagtactgggttttacttggctcctagctctatgcctgttacatagatgatatcagtatgtgttcagtgtagaaatgaaccaccaccagctgtgggtacatcttggtgggtagagcacaaattcaggctttgagaagagctatactttctgaattttaatcctaacccttcactgacctttgtgtaatcatggctcagtgattctgtttcccctaaaacatatctgtatatccatccatccatctctattatctatcttctatctatccatcctccaacatcttctctccatcatccatccatccatccatcttctgtcatctatctacctacctacctacctgtctactttgctttgccccaaaactcctgtcaattttgagacgcacaggcaatatgaaccagatctgtgggaataaatgaggcctgtttgggagccagtttaactctttcaggccactgattctttcccaaacacgctacatacattcactttaagtggcccctttgtgacctggaaaaattaattcagctcccccaaaggcctcatccccttgcaggtactgtgggtatgtggccctgcaaacccctagtgctgtcactcagcccccagcagtgtggccactgacatcccccttctctttcagacaacctttgccttctaccagcgcttgctgggcgagtgcgtttcctgagtggccgtgcggtgctggatgtcacagatcgcctggcaggtgagcacccccagccccaccccaccccatctcctggcagatttctgttctctcctggtctgtggttgaaccattcacccagttatcttagacctgaaataatcccccccaatcatttaaaattttgaaaatctgctttttttgtgtgtgacaatctccatattgccagaagacaatctttgtttttgatcaaaatgaagtaggtttgtacaaaagcaaaagtgtttttaaaaaactgttacaggttgaatctccctaatcagaaaattagaaatgctccaaaacctgaaactttttgagcgctgacatgacattaaaagaaaatgtacattggggcatttccgatttcagatttttggattagggatgcagaactggtatcatgaaaatattccaaaatcagaaaaaaagccgaagtacttctggtaccaaacattttagataagggacactcaacctgtgtgcgtttcttcctccttgcaaacaaggctgcttctagcctatagagtacctttgtgtgagtcagaaaaaagcctcctttttcagacagaccatgcctagtgggtgcatatggcttggtcagttgacagcaccatcaagagaattagaaaaagttgccatgtacaactttagcatgtgcagcctggcaagcaggcaccagctgggtttcaacccctcaggaccccttggccagtgctgggactgtattatgtggagacggggccttagcctgagtctactcagccttgctcaagcttcagctggtgaagggttgctccaatcctgtttctgctttgagtctgcaggagaagtccaagtgacttcattccagggctgaaatctgttcttgtggtccttgaggtggcaacacagaaaggacacaggctttggtgtccacacacccatctgccaccaccagccctgaccttgggcaggttacttatcttggtttcatgatcatttttgcttgcacaaagcctcctcccctgccttgggaaggtcccatctagggaggggggcagagggactctgttccctagactcccgatggtccccctgaaatgcagacagatcatgcaccagccctgctttaatctttgtgagactcctgagctgtcttcaggatagtgtccaggccccctggagtggcccacagctgtcactgctgctctaggatgtgccgccttcctcccaccccagctctatgctcattgaatcctcatgaccaccccacaggaggatgtagattccacttggtggagaaaaggagaatggagctcagaaaagtgaaatgcacaaggtctcttggtgaggagcccaggatgtgtcctgggagcctggctgaagggccaagaccccaaccctgtgctgtgctgcttccccctggcactctgcctcctgggtgcctgcatgcagtggccggtctctcaacttcttgctctgcccacttgtggctgccctgcccggaaagccttctccattcttcttcctctacctgggggatgcctgcttggctctggcattaccttctccctgtgtgcttctcaagactgcatcccacatggtatcactggtctgtctactgccctcccctcctagcccagctgtgagcatccagagaggggcctggcacatgctgcatggctgaggaccttggcaccagctgccctttcagcttctcccctgccccatctcttgcgcctggccttgcctctatgcaggttctgtccttccagcattcctggagtggcctcttaccttacgggaaggcaggtgcgagtgaggcagggctggctgcaggtgagctgggggagaacagggtatgtaagtaagatggtcctagacaccagacaaggaaccctttgccattgctcaaagtcagcattttctgcatgaaaggtttacctgtccttgtctgggtaatttacggggcccagaggtgggcaagtatcttcaccttatccacttactgtaattttttcttgtctatttccaagagacctcaaaagaagagcttctccataggtcttctgttaactctgtgtccaccaggaacacagaagaaaatttttattgacacaggcgaggcctaataatagcacagcttaataggagtaaatcttctgctaattacttcagctgcttctaagcttgagtttaatggggcttgctcccgcatgctggcccccagaagggcctcaccatctttgccagcttaagagtcaacacctgccagccaggcgactgccacatccttgcacctggggaatgtggctctgaagtagcctgagttctattagccaagacgtgatcagagaaggtggcctgggctgtggaattgagtttgggtggggactgctactcttcctgtggagtgagcttcctgggggctgaagtgtaaacacgcctcactctgtggaagagaattcaaggagcaagagtggataaaatgtagcaggatggggaaggaggctctgttggggggcaggtagagcccccccagcctttggtgggggtgggggtggagggtgcgtgcctgggtttggctcttgagatagttctcacttttccctgctgtattagcctgttctcatgctgctgataaagacatatccgagactgggtaatttataaagaaaaagaggtttaatggacgaacagttccatgttgctggggaggcctcacaatcatgccactcatcttacatggtggcaaggaagacagaatttgtgcaggaaaattcccccttataaccttttaaaaccatcagatctcatgagacttactatcacaagaagtacaccggaaagacctgcccccatgattcaattacttcctaccggctccctcccatgacacgtaggaattgtgggagctacaattcaagatgagatttgggtggggacacagccaaactatatcaccccccattaaaagaattgtgttaaaatacacaacataaaatgtaccaccttaaccatttttagttgtacagttcagtggtagtgtccatgatttttgcagtcatcttccgaactgttaccttgcaaaacagaaactacgtccccattaggcactagctccccattcctcccttccccagtccctggcaaccaccaactactttctgtctctacgattttggctattctaggtatgtcatataaatggaactgtacagtttgtctttttgtgtctggcttaattcacacagcagaatgtcctcaagatttatccatgttgtagcgggtgtcagaatttccttccttttttttttttttttttcagagagattctcgttctgtcacccaggctggagtgcagtgatgagatctcagctcactgcaacctctgtctcctagggtcaagccattctcatgcttcaggctcccaagtaactgggattacaggcgcccaccacaacacccagctaatttttttttttttttttttttttagacagagtcttgctttgttgcccaggctggggtgtagtggcgcgatctcagctcactgctacccctgcctccctggtcccggttcaagcaattctccttcctcagcctcccaagtagctgggattacagtcacgcaccactatgcccagctaatttttgtattttttttttttttttagtagagatggggtttctccatgttggccaggctggtcttgaactcctgacctcgtgatccacccgccttggcctcccaaagtgctgggattacaggcgtgagccactgcgcctggcccgatttttgtagttttagtagagacagggttttgccatgttggccaggctggtcttgaactcttgacctcaagtgatccacccacctgggacccccacagtgctgggattatagtcatgaaccacagcacctggccagaattcccttccttttgaaggctgaaaaacattccattaaatgtatataccacattttgtttatccattcctcaatggacactgggctgcttctgccttttggcgattgtgaaaaaggttggtataaacacgggcatagaaatctctgtgttctcacctatttttgcattccatagggattcaggatacttttgagttatcgttattcagtgtaggcggctactcagggtcattcgttttcttttggttccctctcactgtcccccttctagtttcccctcatctcccaccctggggctgacagggactgctttcttgtcacctgttctcttcctactcagcctgtttcaagcacaaggaatagaactctcaactctttccaaccagtgtacctctttgctccactttagaaagctcctccaagccctttaccccaggatcctttcctggggaatgctggggtgacccaaaaggtgcagtcctgcccttccagttatcaggaccaccttcacctctgaggatcctgtgaccctcggaggttccctgcaagagccccaagggtgcagcctcaaagccaacattccttgataaatgtcaccaagagagtgtcaggctgaccagagggtggcccagggcatcttccctggttcctccttattccaggctggctttgaaatcagagggacccgtggggctctaaggggaaggtatcctaggggattagatgatgtggtcctgatgaaggaaggacaaattgcagtttcatgaaaaataaaacaaggtggctcacctatgatcccagcactttgggaggtcaagatgggcagattgcttaagaccaggagttcaagaccagcctgggtaacataatgagacccccatctctacaaaaaaaatttttaaaaaaataactgagcgtggaggcgcatgcctgtggtcccagctactggggaggctgaggcaggagaattacttgagcctaggaggtcgagactgcagtgaaccgtgatcgtgccactctactccagcctgggtgacagagcaagacactgtctcaataaataaataaaacaaaaaataaagctccagatcacctctgaaatatggaatccctagaaatttggggacagcatgcggtagaaagagtgtggactttggagtccaggcagattaggcctttgtcctctgctttgccctttgccttgatttgagtcttgctttcctcctctggaaaacggacaagcatcctgcctctcaggggtgctgtgagcatgaaatggagctgtgatgtgaagctctgagccctgggctcaggcagtttccaggatatggaaactgttttccacagaattcccggcccacagaatcaataaagcgctgctgttagtgttgtttgcctgccccagcacttatccttcggctggatgacaggcagagcatgtgaatcgcaaagccagcttcgatagtgctaatgcgcttaggataatgcggccacagctgaaggcctgagcagcccctctggggacccaggagagcccttgatgtggttttaatgtggccacagccctggcatttactcaggtgatgaagagctggttggcagattcagctggcttctgggttttccggggtttagagagggttgggggccttgggaaaccagatatgggggcttatcactggaatggtctgtgcagagcttgctggttcacaagcacgttcatgcctctgctgctggtctcgtcctgaggtttggcatccgggcaccggggaggctgtgctaggcttctcccctgccagctgtcttgtctgccagcatgcttcatgtgagagggtcttgatttccctccccagtagtttttctctgtatttgtgtggacttccataggtggtgatgtggataaatgcagtattactatagttactatttgtcacctgcctgcctacaggtaggcactttatgtatattatcgaatttctaacaatctggagaggttggttcagcatttttatccttactttatgggtttggaaaaggctcagaaaggtcgggtggcttcctcatgctgacacagttgatgggggcaggattgtaaccaggcgtgcctgcctctttcctgttccctgggctggaggaaccattatgattgtcagagattctgcatatttctgcctttgcgtgcccctttctccataaaaaatatttaaaaattatagtttctgactggttggtataagcacagatataaaccaggttggacatattcatatattttctactaatgttaaaagaagctaacacattttcataggctgctaaatgtgtcatgatccttagttgctgtgcctgctgggctgccagccctttgggggacaaagttggtgtcccaagagagggaagtgggagagggagagagtgcctggctcaagtgactctccttttctgcctgacagtgctggtggcctcagtttacccccggaagcctcaagctgtagagcggcatgtccttcccatcctctggcacttcctgaacaccgccaccaggaatggcaccctgcctggacccagcgggaacatccgcggggtggtgtgccggctgtccaggagcctccaggagcacatgggctcccgcctgctggactttgccgccagccagccaaagcacgtcctcaagacgctccaggaactcttagactcagagtccttgggaggcagccgcaaggccactgacagaggggtggcccctgacagcaagacaactggcagctcatacccttttcagctggattaaagatggatctgaaatgggcaattattatttatcttatttttttgatggactattctcctggttactttcccccttagagttccagatgtacatggtatattttgaagtagaaataaaagaattacttatttttctaaggttttattatcttgtacttttttaatcacagagaattttccagtaactaggtttgtgatgaacgaaatgaaatgtgacagcagcaaaaccagttgcagacaatgttgagacaaagagttaggaagaaaaagggtagcacagccctgcaagctgcagcccgctcgagacgatagttgcccatctgtgagctgctgggcaagccctcctgaaacccgcagcctgagttggtcatcgaatccagtccatttgttatgggcctgattggaggtgagtgtaacaaacgtgttcagggacatcgtgcttctgccctgcaaaagctgcagcacgtgtctgttggtcctgtgggaaccttctgatcggcccagcttatcaaaagacaaggggaatttgagatttgcatcactaaaagccttctctagaagttggagttctggctagttctgaagaggactagacaatgctttgccattgaaacaccctaaatggagatgcatgtggagcgtaaagtgctaccagtgtgcagatgctgccgagtctctgaaactgcacaggctgcaattgtgggccacatcacaaggctggaggggcgagtgggcacagcacgggccaggacttgtggaagcagggaaggtgttggcccctgggggaacagccagtgaaatgaagtcccggcagtggagagggaagtctggggctcaggctctggacactttaggtaggagtggctctgccttggctggggccagtggcaggttaacaactgtgtgaccagaaagagttagagctaaggccatgacctcaaatgcacaggcaaggcaggcctggtaaggcaaaggctgaagaggcagcatcccagctcttgcaggggagcccagcctgcagccacgtgctggggcagatccagacgaccgaggccctgagggcccagcctcatgccagcaagttttctggcagacacccccctcccctgcccttccccagtggaacctctttccactgtcatctgccccccaggcctaacatccattccacatccctgttctgagcctctcctggggagtctggctctggaaagccccgaatctactcacttatgtatttccataccccaccaggctgaggaagccactttcccatcttgcctctgtggcaggtgtagttagtccggcccctccttacgccctggggtgaggttgggcctgcgagtcatcccgggccttgggcttgtcataggcggcttaagagtgactttgggtaattctagcccagtgagctgcttctcacctgattgtgaccccagcaggggcttccctgcgaccatctagctctttgttgattctgattgaaccaggttaaaggcctgctagacaggcagccatccaaaaatgcccaagaggctgacagtaaatgttttaagtgttgaacaatttaatgaattgcatttgcctgtcatctgagcaaatgtttttggtttggtgaggagacttgcattttctgcttttatcctagaatgtatcagaacatttcagggttttttagatccctaggaggccagggacgtagagtctggcaaggattttgacggcagaaatgaagcttagcagtactgtcctgtcttcctgccttccatgtgtgttctcacacaggaagcttcccatcccatgggcctccacccactctcaggggcggaggcattgaaaacagctgaaaacagtggaaaagtgcagaatacatctttgcactgttctcttttccctcattatttcaggttttattaaccacacctgtggtgtgacgctgctgggaggcactgggtggctctggtgtaccttgagaaatttccatctccaaagacttccttacctcattacttttaaaatgaagggaagacagcatgttggtaacctggccctgggcctgttgggaatacctgtgggaatctaatgggacggcctgtcatgggacatgaagattttcctaagagctggggctggagctaagcccacacatactttgcttggttctgtgtgtggccaggaactccacttacatgagatgctcttgggggtgggaatacagcctctaatgatggaagattctctttctctcaatctctctctccatgtaacaaaaatgcaggtgcagtcactcactgcttgcagactccagtgaacaaaagggaggcctggtataaagaaactgactttttattccaaagctagtttaggggaagaagctgccttgaagggtactgtgtcgtttttggagcagaaagtgggcacttttaaaggggcgggggggggggtgctggcacgaatggcatgcaggagaggaagcgggcaggtgggggagtccacatacttgctttgatgacttatgtaacgggtggtcaagttggcatcttcgtgggcagaactaggttgtaaagtggctgaagctctccgggtgggagggagtttcatagtgggcatattttgggttattaattgactgttgtgtctccaggcagtttcctggtgggtgcaagttctgctctagagcttctaagcacacagttagatgagcctgccctggagggagtgtctggtaaaggggaggtaaaaggttatagttgcatttcttttatatatatgtttatttgtttatttatttattatactttaagttctagggtacatgtgcacaacgtgcaggtttgttacatatgtatacatgtgccatgttggtgtgctgcacccttaactcgtcatttacattaggtatatctcctaatgctatccctcccccctcccccaccccacaacaggccccggtgtgtgatgttccccttcctgcgtccaagtgttctcattgctcaattcccacctatgagtgagaacatgcggtgtttggttttttgtccttgcgatagtttgctgagaatgatggtttcccgcttcatccatgtccctacaaaggacatgaactcatcattttgtatggctgcataatattccatggtgtatatgtgccacattttcttaatccagtctatcattgttggacatttgggttggttccaagtctttgctattgtgagtagtgccgtatagttgcatttctaaagggctaagtaggaagtggggaacaaggggaaatggggaaaagagaagagaaataattttaaaaactcgttttcttagaaaaatgagtgtactcagttcagagtgagactcatagacagaagacttgtctgagagctgtaactgccaggattcccttttacatcaaggagaatttttttgagattttaggaaacttttcctataggtcccattgtggcaggccaggtatcactaatgcaggcatccataacaactgtttcaatactgactgagtggttaagttaaacattaaaagctgagagagctggtggccttatacaaaggctggaatgtaacaaaagcccaccaagagtttgcctaggcctttgctgggccttgaagcatgatgagataatgaaggaattcttagtgggacctgtttaggattaaacaagctttactgggtgtctgaagaaactccccaggcctccaaaaacaagtttattggaggtctgaaggaactccccaaaccttcaggatttagcaggagacaagataagggtaatcaccccagcacctggacccatttagattaagtaaatctattgaggctccagaggaaggtcttcaggacttagatgttagctacagattaaaagaaattaatcgcttatgtctttagatgagtgcacacttacacatagacatgtagcttagaagatatgcaagctctggaaaactttgtaatttgagttggtctggcgatattttccaggccttctccctgtaaccggttatggaaataaaaaactctcttcctccccagttcatctgcatcttgttactgggccacgagaaatagcagcccaaccctcagtttggtccaggaacaaaatctctcatcttgttttctcctccctttattatctcctacctgctgagataataaacgtttctaccctctcactgtgcttcggaatcatctggcaagacttaaaaaatactgaggtctacccccaccccacagggattttgattcacttggtctgaggtgaagcctaggcagctgtatttttttttcttttaactccaggtgattctaatggctgggtgaattcaaaaaccacaataaaatatcagataaaaaaggaaactggccatggcttaggccctgtgggctcctggcctgccagctccccttacctcacagccctagagtattctggggttgacggtagaaactgagtccaggctctggagtcaggcctgtggcctgctggcgtgtggcttgggacccatctatcaacctctctgatctttccatatcaatctagtgtgtggatgacatcaatgcccacctacacctggctgtggtgacgatgactgagaacattctcataaagcatttagcataaggccacgaaaacagggagctgttctgcttggggcctgccatttctccagctgtcttaccctttctccagacgccctcagaaccatccctccccccagagaagaaaacccagaagctcttctctccttgtggctgttccttcccctccactcttctgactcttgagactggagaggggatgatttgcaggggagcagagtgctttcttgcctaaagcattttcctcttattataacttggttctgccattaggaaaagaaagggggaaatgaccataagtctcctgctctccttgtgatggagggaggaagatgggggcccagaaagggaagccgagaggaagagccaacctcctcattaaattctgcagtgttccaggtctgccattcttcttgacatcttataaggaagatattatttcttccatttcctgatgaggaaactgggcctcagcgatgcttaatgaataaccgcagccagtgcacaggaatcacctgggaatcttggtaaagttcagattctgcttcagcaggtctgggtggggcctgagagtctgtagtgttcaattcccaggtgaggtcaatcctgtgagtctggcagggaccacactttgaggcgtcaggtcctaagacagcaagaaagtggctgaaacttgggtgtgtgtccaggcctgtttgactccaaagcccctgactttctgttccaggatgttttatggctccaagacatttacctccccttgggtcagtttgagccctttgaaataagccacggaaaccccatggatttctggagttagtctggtcccagagttttgctcccaaaagcttcagggcagagagggtctgcttggtcagctctgatcattaggacatgctgtgaacacttggcctctggtggggacgggatttgtggacacaaatgaaggctacatgagcaaagtgtagcctattcagagcttgctatagcaagggagcctgccatgacgacctgagttttggcagagactcatatgcaagcagaggtaatgctgcagcttcatagtggaaaaaggggagacttcaggtatgccctgattggaagctgttggcctggggacgctgtaggcacgaagtgtggactgtggcttgcttgttacagtatcacccacggtgcttgttaaagtacagatccctgggttgtactgcagacctaccgaatcagagccttgatcactcaaagttgagaacctctgtcacaatctcaaagctttcagtggttattaggttcccaggctagcccacacctgggagtcagcatccctaaatcagtctttaccaaatgtggttgatgaaaagaattgcttgcgggaggagaacggggagagagagacgggaacaagtgctttttaaaaactcagactcttagtctcagctgtagatctgttactggggggaaggcctgggaatctgcaaattatcaagcagctgattctgaggatcaggaagcctgggaagcagcgtcctaactgcctgctcccagccgggttccagacagcacggcagcatcactgtgtgcacagatgctccctggtgggtgtttctgagtcagggacctcttgggggctcaggtttggtccttatgattactggggtttattcagggggcgtgctggtttcgccatattccgtcccctggtgtttcagtgaagctggctgtaacatttgaaggctttgctttattttaatcacatctttataattacctcgctgtgagttgacagctgttattaacatcaccttgggttctccttgagaatttttacatccttaaagtgatgcggcacttctgcagctgaagtcagaagccgttaactaaataatcgctctaaaatgtcaccaggttttgtaaacatagccaatactgtccccttccaaaggaggaaaaaaaattgctagataaataattttcatgaaggcaatttgtttcccagggtctatattattttctgtctcatccactggtttttgccgctgtggggcactggcaataaagagctgtctcaagaaggaggccacgtctgctcctgccaattttcatctggaagcccacttcagggttcatggcaatgagaagcaaagatttttggaaaagacttttctttttctcttaatgctagcagcagttgtgtgtgtgtgtgtgtgtgtgtgtgtgtgtgtgtgtgtgtgtgtgtggaaaatgatgggagtggttgaggttcatagagggaattattttaaaaactcttggaaacattgttttgagttttcatccaagctagtttgaggaatggctagaatttcagctgaactttgattagatatgaaaagtaatgtcctgggctaggtgtggcagctcacacccgtaaacccagcactttgggaggctgaggtgggaggattgcttgagtctaggagtttgagaccagtctgggcaacagagcaagaccccatctctacaaaaaaataaaaaatcgtagctgggaatggtggtgcatgcctgcagtgccagttaatcaggagactgaggtgggaggatcacttgagcttaggagttcgaggctgcactgagctacagtgagctatgattgtgtcacttcactccagcctgggcgacattgagtgagaccctgtatctttaaaaagaaaaataatttcctatttgtaaatgttggagaaaatggagaatttcttccatagaaaggtatgctgtctccttccagtactgcctctatggaataatctagatcttgctttcagcaggtatcaggaggaaggctggccagggtaagaggcctgctctgccctcactggcaatgtatctttggagtgagatctttttttcatgtgtaaaaggtattgaaaaaacacttgctttgtccatctcatagcgtcttttttcctctaaagatttaatgaaacaatgtacatgattgcattttgaaaaagtagagtgttacatacaaagaaaggtagaattattaactggagcctcatcccacactgtgtgcaaagcctgctgtttagcagtgttcagagtaattgccagtcatctatctgactgactgacaagcctcatgactcaacatgggaaagatgagagattcagaggcttaatttgtttttttccatgtggtatatttgacatatgtacttgcaattgcaagcaaatattgtaaagtcttttctcttcactttgaaagacatgaaaaccttcaaagaaggaagtcaattcttgctgagtttgacagctgtttttaagtttctccaaagatcaaagcgcagcccaggaatgagggggaaatgatattggcttcttttctcaatcgggatcttaaagtgcggaggcagcagagatgaacactaaagaccaaaatggccaggattatgagttccgttccccgaggtggctcaaaaagatgccttagaaaagacaggtttgcccctgttgtgcagatggcaggataaataggctgacattattatcactgctttgcagatgaagacacgggctcagagatgccaggtcacagagccaggggatggaggtgtcatgactcaggctctggtgttctaattccaactctcaggagcgtgataccctctggctcctgagaatgcgtggcccatttaccataccccttgtttctttcccctcctgctctcttcctcctctttttcttcttcctccaatttaggccagtcagctttatctatgggcattaactgagccccgccagtgctatcactccagccaaaaccgattgctgcctcgtgtgctagacttcaaggctgtctgcagtgacagcgttcagaagcgggtgactagatcagtggaatcctagagccacctgatgcagggcccaccgaccattcacaaagttactttgtgaagtccaggagtgcgatcaagcctgcagtgtccagggtccttcctaaaattgaattagagtgctgagtgaattaactgtttgctcctcttcttgtgtgatgcatttttaattacatttcataaaaacgtctggatggattgatggagctttagttaaacttcaggtaggcagggggagtagacgatggtgcagtataacatgttctgttaatacaggctcagaacacatgtactttatggcagttcaactgaatctttgatgtagggctacttaaaaatatattacctttgaaaagatttcctttgaaagatagagtgggtgctttagcagcctgtaagccgtcagccagacgatcaattgacaaacacgtcagcacttataattcactgcagcggctcccctgatacatgcaaaacactggtttatttcagaaaaagaatatatttctcaaaatccctttcattcacattgtaaggtttatgaggcaagtcttgtcaatcctaggcccttcacaatgaaagaaaagtctctttggtctgtctgccctgcgtttcctacaacatggattattttaggctctgaactgggcatacgatgtgaggaaggagaatagatacggcttaaagtaaacagcagctcagaccccagccacggagggaggttatatttcattttgaagattgtatttatacttgcaaaaagctatcactgttctgccagaatatgatgtttactttttttttttttctccatgaatccttttgatgggagcagaaaattctgtttttttccctggggtggaactgtttacagtgtcactaaagtgttgggtaaagggctgggctcagtacctccctctccacagctctggggtctccatggtcgggaagatgaaagctgtgctcctccagagtggagctggcccgagtgagaagatgggtatgacatgtaccccttagattgatctgtggtgggttcctccttctctgcatcccggacagtccttggtttctaactctatgaagaaaaagtatagactcatgggtcttcaatgagttgggttcattggcttaataatttttattaaaacaaaaagcagaacaaagaaaaactgtcctcccttcccccttgggcaaaggaagtggatttggcccagcaaggataccattcttgggtagaagggagatggtgggcgtgagcagcccttgtctgagaagctgtacagctgggtttgcccctcctgccaccagcaatgcgtgctccaaggcagactcaagtttgtggaagacctggtctctaggaggcaaaactgaccagatgccacaaaactgttccattgtggatttaattccttttgtacaaagtctaattcacatgtaatttgagctaagtctggtagttggtatggtagccaaaaacacatctttgacccgcctgctcctatgtcggctcagcactgcttcacctttgacctaattgacccccagcccccagcaccttggcaacccctccccatcttccctggagtgggggaagctgacttggaattccagtagcctaaggttactgggcaacacaatggtgtcaccagctcactgtcccggctgcctgggtctggtggcagctgggggcttttatgacatcgtgtgtggggacctatggcaggagcctcgccctgtcctggcacacgttggccccaagcaaacgtggaggtcctccagagggacaaggaggcatcatgggcatctccacagctgatggcaggatcccgggtgccctgtaccccttcgtctgctgcctgcaatatggtgggtgggcacttcctgctgcttgccagcctagcctggcgagggacaacctctagtctcagacagcctcctgccatgcatgctcacggaaagcaccgttgttcattccggacccttcctgcgtgttctccatgatactgaccccttctgtggtggaataatctgcctggctccctgctgccgctagcttgcatggccacagcagggggcactcggccaccctttccactttctacccagccctggacttttaagatgaggccctttacggaaggaggcctgggctggagactcagccttgcttcccctcactgctggagtggctccacttcatatcccggttccagtaatgaaaatgtgtataattcctggggttccacccctcatggtaccccagtttcacccactgtgtcccactccagtctccctgcagctggggaacagcttcgtttcctcggacctccaggaatcctgcccctaaatctgagcccaggcagggcccactttctgagcagtcccacctgaagccacttacttgtgagctagacctcaaaggccgctcacactgtgtgtctcctgctcactcagctcagtgcccagcttacctaaggctcaccccatggtgacccaatggttggtctgcccaaccatttagggagaatgcccagatctctgtcgggcaagtttgctgaacctggtccatcctcacgtgcttaccttggcccctgccctgcctgggtggctggacttccctgcgttgcctgcagtccaggcagctcctaagtgtccacccagcagtgggtgtggcttggctctagaatcggctggcctgggcactgcctgagcacttctctgagatgagggcggcaacaggagcaaatgcgagcagacagctgggtgtgtccctttccagcagaggggtgggttgtggcccctcttggtagtttaatcagctgttctttgggtgcctttgaataataattggacaagtcaaggtgggattcatttactcagagtcatagcctctctctgggggaggttgctatagtccctagggacccagtttaacaagtttttgagcccacagtcccagcaagaatgggtttgaggtctataattaccccaaactttaaaaatcagctttgcagcagatctggaggatcgtccctttgctgtaccccagtgggtaagaattcttgtcttttgccaacccattgagccggcattgaatcactcaattactgcaaaatcttttctaaatagaacgcacaccacagcctccagtggaagcattccaagatctgcagcaaatatctagctcattggcagaagcaggtttttggcatgaacaactgtttttcactttgatttcgactccagcagaagttctgcaagatgacctgggaataaagttggccaagaagcctccgaggggagatcggcgtgtgagtacgtatgcctcacccacgctatcttctgagctccagcacccacggcatgtggagaatgggctgccttgtttgggaggcttggtttaccctactccgtcgagaagcatgtaatgcgtagggcagtgagagcatttgctacatgcttaggccgagaggcagcgtggctggtattgtgagctgtcagctttaagtttacagcattgaaactgagcttgggaaggaggagaggacagaggacgggtggggctgtgtgttttaatcctggctcactcagccttctcattttgggagccatgcacttctaaacaaagctctcaatagggactttgtcaatgctgtgccgctacttaaccttacaacaaagaagctttgcgaccatttgcgcacccatgtctgctttaggcaggtggagtgacgcaatagttacgggcaatggaatgtaataaaaagagcagagagattctaacaccagactcatctgtgcaaaattttgctctattctcttcttagctgtatgaccttcagccagacacttgagggggcctctccccacaccttcggttttcatatgcgcaaaactgaagaatgctatgtgcttcattcactgttgtgaggcttaagtgatctcaaggaatgaacccagttaaaaccctatcaagcatgcaactatacattctccaccccccaccccaccccaaattaaggccagcacttgaagcattaaatactgtcattgtggggtctaaaagttctggttaacctttgaaccccaaggcagagcaagatctgggactgaaaacggcgattgtttaaaattcagcagacccactgggcagtgcaccttccaggcctttccaggacacctcagtaggagtttggtttgcccatcatctctgggtcaggctggacacttggctgtcacacttggccttctggggtgactgcgtgagtgtggccccctcgtcagcctgtcaggacacctcctcttgctggggctgcgcctctggctgggatttgtcctggatgtggccggtccgaggctccggttgcagcccgtggcccagcacacagaactctgggggagatgcacgcctggtgccgccctgcagttcaggggaacaggggctgctccccggctctgtgtccttcttagggctctcctcgctgctgctgccgagagaaaggacaagtgcaggtcagacactcctcctctgctgctccttcctgccccacccctgtcctccattctccctttctgtccctccccagccctctcccacaagcctgttcaccctgggtgccaggcctctgccctctgtaccaggcttgccaggctggtgccgccattgccgtgtgcctgcaggggtgggcgctgtgggagctggggtgactggctgagtcctgttctttcccctgaagccctggatcctgctgctctgaacaaagcaactccctcagaagctctgggagctgggcctttattttgtttttgtttttaaagcacttcttgtttaataagggttaggcttagccagttgaattaaagacaacaacaacaacaaggaaaaaaccggcttcgctcagctgccacccttttcccgaatagagaaaaatgcaaacagcttggcccagcgcaggccccgcatttggctggaacagagattctcagctgccaagtgacacagctaagaggggctttgcatggggagaggacccccacaggagcctgagtgggatttgggagtgccttgggagtgcagaatggagggtggccctgagcatggagcaagctttggctagcaggggacctgcccaggaaaccacactggccgtctgctggcaggacagcctgaggcttcccagagtgggaattagaggctgactgcctggtttcaagtcctgactctctggcttattagttcacccctctgaatctttgcttccttccttataaaatggaagtaataggccgggcgtgctggctcacacctgtaatcccagcactttgagagtcctaggagggcggatcacctggggtcaggagtttgagaccagcttggctaacatggtgaaaccccatctctactaaaaatagcaaaaattagccgggcatagtggtggacacctgtaatcccagctactcaggaggctgagacaggagaatcgcttgaacccgggaggcagaggttgcagtgagccgagattgcgccatagcactccagtctgggcaacaagagtgaaactctgtcttaaaataaaaataaaaattaaaaaaggaagtaataatagtacccagctcatcaggcactcataggtatcaatactgggtgaagcatggaagacccttggcatactattgtattaatagcataagtgccccataggtgggtagtgacactatggagctgcattgttgaatgaacaggaagtcacactaggaaaggactctagggaccacactatcctactacagggactatgaggccttggtcagagctctcaatcagttgcctcagggccaggacaggaccctagttccccacatgcacaggcaagaaggcccttctctctgctcgcgacagcacattcttgcctgatctgtgagctttattgcacaatgtgctcagctctgtgaggtcaggcttacatgggatgccaaaccagtggagaatatgtttgcatttggatctgaacaagatcgaggtgggtggtaggagtcgtgggtaagtggggtgggcgctaagaccagcacacagctatggttgtcagacaggaaggaacccaactcactgtgccatggagccaatctcatctgtgttggcctccggccccatcacaggtccctacaggagttcagggcccagggcccactgggtatctgatccaggagactgagtaagggcggcagagcgtgcatgcctgggcagtccaggccaggtgaagactgaaaacaccacattgaggggagaaagtctggagccttctcaaatgcacacagtgccccaacatcctgagacctagaggctggtagctctgctgggggatttggcacagaaataacagttgaagctcagtaattgagcttcctgggtaagcctccaagggctgttcccaatccccaggtccccaagatcaggagatataaacatcatccatttttctaaaaagggggcttctgcctgcacggagtgactggaagggcaggctggttcagcttgcaggcctgcctcagctgcaagacatcatgggtgtggttgtgtccctgcatgtccgtgcttggggaaacagcccgttctgagcagcctctggcttcctggcactggcttgttgcatgatcttggggaaatcatgcctagtccctggtggtgtttccccatatgcaggatggcagaaaaaaatgcttgccattcacagggtggcaaaggcttgatatgcttacagcaggtgcacttctgctcccagatgccaactttatacctgggggcaggggtgctggggaatgagcactttcccatcacatgctcacagtgtgggaaggcttacagctgtgtggtgtcataagaggcgggggaatggttgcgagtcattatacaaccttccacgtgaccttgggaagcgtcctgtttatgaaccctcccctctctctctttttttacatttttctctagatgaggtctcactctgtcactcaagctggagtgcaatggcacgatcttggctcactgtaactgccacttcccaggttcaagcaattcttgtgcctcagcctcccgagtagctgggactacaggtgcgtgccaccataccctgctaatttttgtatttttagtagagacggggttttaccatggtggccaggctggtctgaaactcctgacctcaggtgattcacccacctcagcctcccaaagtgctgggattactggcgtgagccactgcacctgaccgtcctctctctttcaagccactgttacctccctgccgcccctgccccaagtattgagattcaggacacaaaacaaccttttaggctgccctattctgaggagaaggctgagagaagggcatcattttcttcttgaacaattttatgttactttattattgctcctgctgttttaaaatgttagtgtttttaattaatgccattttattgtccctgttctctcaagctcttctgctgaagggcacagttctagaaatctaataactgaataagtggcgggagtgaggaataatgcattaacatttatagagattctcagatgaaaaccactgtactgtaggaagctcattttagatttaagaaaagagcaatgttacattaagattcttgcaaaaataatcaatatttcatttctttcaagtggctggggaagtttatctaactgtaataatgcacaactttcccaagataatatctttattttacattgactgccgagtactttgtaaaaaattaccatttgtgcctggacagattgtgaagtctgcaaaacgtatcactctggcagaaattaactgctgatttacacaatcgtgggctatgcaaagatagcaaggaccgatgttagttgagctttgtctgatcttgatagacacattaataagagttcttctctaatagacctcagacattttttttttgtttctatgccaggttgggaaaaggcacatttccccgtgtattctgtaaaataaccacttgagcatacgagttcttctttcagtgtccagtaatggctacactttgactcacgccccattgcggctgcatgcctgggcctgtctgcacggctggaccaatgacatgcacgtccattgccctgatgagaaaggcacacttggaactcagcctgcccgggggagaggtagcagccccacccctggattctggtgctcagcactcatgaagactcttgttctcactctacaaacttttgaagttagaggagaagtggagctaggtccttggggatatgggaagccacacatttatattctatgcctccaggactagccattctcaaagtgtagtctgggggcccctggttattcctgagacacttatagggggcccacgatgtcaaaactattttcatcataatactaagatgtcacttctctttctcactcattcttttgtgaatgcagggtggagagccccgcgtctacatgaggtgtgagatcccaacaggttgacaatggaagcagagctgagaatccggtcatcttatattaagccagatgctaaaaaggtttgaaaaaatgtaagacagtgctactcttctccctaaattttttgttgttgtagaagatactcttttcataaagacacatgcatgcaaatgttcattgcagcactattcacaatagcaaagatatggagtcaacccaaatgcccatcaatgacagattggataaagaaaatgtaatgcatatatataccatggagtgctatgcagccataataaagaacaagatcatgtcttttgcaggcacatggatggagctagaggccattaattatccttagcaaactaaccaaatactgcatgttcttacttataagtgggagctaaatgatgagaactcatgggcacaaagaggggaacagtagacactggggcctccttgagggtggaaggtgggaggagggagagagcagaaaaaataactattgtgtattattagtacctgggtgatgaaactatctgtacaataaaccccttgtgacacaagtttacctacatcacaaacctgcacatgtacccatgaacctaaaataaaagctttaaaaaaagtggacacaagaaaatacacactttttataagagtatattatttgtgttaacgtattttttaaaaaaataataaatattttacatatttctcagttttaacttccaatacagtaaacattgatagatatagcctccacacgcaaaggctcttttgggctcttaataactttaaagggtttaaagccatcctgggaccaaatagcttgagaacctcccaactagatgctggtctcctgcggggaaccagaaacatggggagccaggctgctggtttgagacacggcaccagtgagccagccacaggggcaagccttttcatctcagtttccccagctgtaaaacatggggtgtgtggggttgaactaacttgagtgttttgaactttactattttatttttttgagatatatatatatatttttaagttctgggatacatgtgcagaacgtgcaggtttgttacatagatatatttgtttcatggtggtttcctgcacctatcaacccatcatccaggttttaagccccgcatgcattaggtatttgtcctaaggctctccctccccttgttccctaccctccaacaggccccggtgtgtgcccttcctgtgtccatgtgttctcatttgaacttgattttttttaatacagcagggcctcttttcaattaaaatatttcctaggcagctggaatgtgtaacagataagagcacagtaactcaaggttggagagtgggggagctggaactgccccctacacctttttcccaactgcctcttctcttggagcacagtttgaaaactactgagacccagaagatcttttggcccattcgctctgttcctctctagtccaagccgctgaagggcagtgaccccaggacactccttacctgttctggccgagctgggattcataagaggtgctggtggggtccaaggtgggaggctgcggtcggccacctggctggcggtcagaagctgtcctcctgaggaaaggcagagggttgagggcacacagagctgctctccgctgcgagtctgctctcagccaaggccctgagctgttcttccagcattctgctgggttcccgagagggcccccagcctctggcggcagcgatggtggggtcagtgggtgggctgttgagagtggcggtttagcttcaaacagagaggaggtagctgggcagaatatggaatgtgtgttcccagacactttggctatgactgcttggctgtcttcagagtctcttgtttccttgtgctcctgagaaggggacattgggggtgatggggagggaatcgagaaaggggggcttgcttctgggtgctgggttggggggctggggaccttgcactgagcaggtgcactctcggggggagggttgggcaacttgggctggtgcggtggggaagttcgccgctttgtggtgggtgggcttagcaccctggggctcacaggtgggctggggggcgtctgcacagcagaggggcttggctgggcaggtctgtaagaggagggaaggctccggcgcctcttgtctgcttgaggcacccagtgtgtcctcgtgggagaggcctttctgcccacaggggggcttctctctcggctctgccttggtctggccaggctggactctgaggtcctgttttgtccagatggagggccggagtggtgccaggcgatggccttccggggctgcctgtagaggctggtggccttctctgcctgactccaagtcccacccttcacctcggggctttggctggtggctggtgggctgctcaggtccagggctggcttcctgggctggcagctgctcctgccactccctggccctgtgctgtgaggcttggtcaggctggcggtgctcttgctgggcagcaagtccagggggctcacagaggccctcagctttggggaagcccatgttctcctggtggggccagcctctcccggccctggctcctgggtttccttgggggagttctctgtggacttgctgctttctggggactccagagaagcgaatgatttgtccatcagaacttccataggcggtggagggaggtgctcgaggttcccctccatttcacagctgagctcctcactcttggctgcttctgctttaggcagagggggaaagataggtgctaagggcttccagcctatgcccattttgagagattctctgcctgatgctggagaaatttggggcttcggatacaaaggggcaagccctgtgtacttgggaaatctggggggcatgatgcaattcctgaggcagggacttgccccagcgtccttagagtcccccagcatcctcagactctccgtgggactgaaagtttcaataagcttcttgacggatgttctggtgggacagcctctgacattccagtctgtggccttggcagcctcactgacctctcctgatgggatggcatttggaagcttcccagctttgccttgttcgtcctcaggatggggattgcatttctgcaagatgctcttgtcctgactaggcaaaatactgaagttcttggtgagggatgccttgagcctgctggtggtgttgcttggactgaccctgcaggtgccattgggccacacggcggctgctctgggctgcagaatttgctcctggctctgcccctgccctttggcacccagggcataaaatgcctccagcttctgactgaggtccctctggacccttcgcagctcctgaaaggtggggtcctccacgtgactctggagacacgactctgactgggacctcgtctgcctctcaggggccctcctgctgccacttaccgtgctaggtcttggggggaccactgtcctcccctcctcctcctcagaccagtcctggtgcccacagggcacagggacaaacttgatcctttcgctgattgactccttcatcttcagaatcatttcctgggcctggaggctcctaagcctcctggtgcgggcctgaaatgggctttcccggtcagcaggtgaagattgtggccttgaatgtggagttttttcctgccaggcacacagactcatgctgctcattttgtcttcctcctcctcctctgggctgctgtcctcgctgtcactaagagatgaagcgtccatcggcctggaggttttggaaaggtgtggttccacagagaccccaatcccaaaggaatcacatggggtgcttgtccccagcttcaaaggtggggaggtgatattttctgggcttgtactggagaggcatgggctccttgcttcgtcctgtgctcgtggctgaacctttgccataggagcccctgagagcaggcagtcctggggtctgcctgagcccaaacagaatggactttgctgccaggtgtgtcctgactgcctggcctctgtgtggggtgaagtcaccgacttccattcttcgggctctggtgcaaggtcccagctggtttgcttgcccagcttgtccaccgactgcacggactcattgtcagcaccaatgccactgtcctcagagcataaggggagaccctgcaccccagggtcgccacagccactcgccaggctctctagctgcctcagagccctcaggaggcgttcatccacattcctttttgtgctcagcttattttccaagtgggttgcagtggagtggaggtagctgctggagccctccaggaagctgccggtgagcgaggccactgtgccattgagcacctgcagcttgctgactgtgtactgtagcagctgttgcaggagatttggctgctcctggggctctcttttcttcaaaggccaagccagatcctccctgacttcctgcaggagcacttctccatccttggagatctcccccaacagctggctgatctcctcaaagcacagcagcaagaagctgaccatgggctgcagcagctcccgggtctgggtggcctgatggatgatgcacagaattgcttcatatttggagaggctggagtgtagataggtgtaagcctgctggtgggcctttaccagaggctccgggaagtccactttgccttcaggctcatgagcagggtggatggtttggtagcagtggctctgtgtgcttgacgtgtgacattttgctgtccttttccatttggaagtatcttgggtactactttcctcactctcatctccagaaaagtctgccccttgtgatccatgggaaccctgtgtcttgaacggaatatccttagccatgtggctttgtgatttgttcagctgggatgaagaggttttggttcctgggatcagtccttccatatctttccttttgcctgaagcaggatctcccatgagctgacaaagacctttagctgtggtttggttcctcctgggacttggctgctcctctgccaggccctccccagcgtcatagcaggtggagtttttaaccagcaaagggatggaacctctttcacttccgccctgacatcctggccgaattgctttgggctttttcaagaactgaatgccactctttgcaacgctgtttacaaggtcactgtgtgaaggtgtacaccccatgatttcagcttgtagtcatcttccacccaccttcacaattttccaagaatcatatttgaaataggaacaaaaggcaatcttactagtccatccaggcaattttcaggccagaattctttgaagtccatggtacaatatcctaaacttggaaccagctttctttattttcttggtccaaatgtgaagagggagtggtacctgtcgtcctgttgttgttctaagtttggaaccctctgctgttagtgagcagcgggacaattctgaaggctcccagcctggtggattacgggcctgtgttttgctcgcgtcctgacagatgtggatagcaagtgcagcttaagcctattaggttaatcatgccctagccagtcagcactcacagtgtgttctaatatagaacttctcagcatttactatcttgggaagcggattatttttgcacgtgctcatgcttttaattctgttcagacgcctgccatatgaaacctagagaaatgagccataattgcaaaggctctggaagagatgcatttgtggaagagaagagagggctcgttgattacaggccctggaagagaagtgaccttcacggtttaataagggcaaaccagccaagtgtgctccaatctgctgttatcaagaagcccccaaaacacacaatagataataattgaagtaatgcattattgtttgtgtggcttataaaaaccccgggactctagtatagagaatgtctctaaataagatagtgaatgaagaaggcaggttgcttttcctttgcattagaaaattgagttaggtagcaggaaagctatcccccccagtttggatggggacagcaggaaaagtcactgccatgtaaagctcaaggctggtcactacgctcaggaaggcaatgctttcatgggaagaggcttcttattcaaacttcttcataggaaaacaagctaaaaactgggcagtggagagccatttcattattaagaggagaactcaaggggaagcccatttttctgctcaaactgagcatggggctcctgcctgtggctaagggtagcagctgcccatttaaaacctccttttaaactttatttgctgtcagtaaaatctagaacaacagcttggcctagaaagactggagtttgaatcctgagtctttctcctgttagttgaggaaacttctgatagtttttaagctttcctgaggcagagctcatctttgaaatgaggaccacggtacttacctcacagagccattgtgaggattgtcaattaatacttggtaagtgcttgacccaaggtaggtactcaaaaacatgcagtttcagccaggtgtggtgactcaacgcctataaatctcggcactttggaaggttgaggcaggcttatcatttgagctcaggagtttgagaccagcctgagcaacatggtgaggctgtctctactaaaaatacaaaaaattagctggggatgttggcacccacctgtaatcccagctactccggaggctgaggtgggagaatcacctgagcctaggaagttgagactgcagtgagctgtaatagtgctattgcaagctggcctggactttggaagtgagaccctgtcttcaaaaaaaaaaaaaaaaaaaaagtttcttactcctttccccctggaagctagggcacttataataatgaaagtcataagaatttcattggtttgcgttggtttattcctgaatggtctggaaataattgcctatgatgcacttagagccctctgaatctggtgttctttttgccccccacccccaccctgtgctcaatccactgctgcctcaggatttttctaaggcctcattgtttaatttctcggctctcaaacacaatgattcccactgtctgcaggagggagaggggcttttatttaaccatttcctatttttgggcatctaggttgttgccaatttcgaaattttccaaatagaaaaacattgcattgagcatctctgagcatccccctgaagttgctgagattggagttgctattctggctttccagtcttcattttttcccacttcatacaaccaacgaaaacaacaccatgggtgtcaggatgtctccaaaacaggcaggacttagagctgcctcttgtactagctggagactggccactggggctgtgtgcagcgcctgctgcctatcacagcccgatgccccagagtgcatcattaataaacttccccgatctgtttatttgaagcagaactcaggcgagacacaaagccgaatcagtgcctgcaggcgagctgcgttaggcatcaagacgttgcttcatttgtcacagtgctgagctggcccagtaaacaagggtgccacgtgggaaggctttcttttcccttcgggtcatccatttaacagagtgaaaaactcatctggaggatgctttatgtaaattcttcttctcttgggatttgggcccctgcttgactcatctttgtgaaaaacttttatctaagtgactaaaattatttccaaaccaatgatcaaaatcaaagtgtttgcctggaggatttgctgtcagatagctctgtaccttacacatgagtttccttgactattccaagtaatttaggaagctctttattcattgctgttcatttttcattaagaccaacttttgtctttctttattttaaattggatttgcttcaaatgaaaaaaattattttgagtgggcatataaaagtacaactattttggaaaactgttatttaaaaatataccctgtgacccgtcaattccactcctaagaatttacccaagaatattgaacataaaggtctgcaaagagactgctataagaaaatttatagttctactcataatcgcctcaaattggaaacaacccaaatgtttatcaatagggaaatagataaatttgatataattgtacaatggaatactacctagcaatgaaaggaacaaactaatgaaacgtaacaacagcataaattttaaaatcattatgatgagtgaaagaagctagacattaaatagtgcaaggtgaaacattccatttttatggagttcgggaacaggcaagtaatccatagttatattaaataattagaaaagtggtgaatctctaggaagagctatcaactggttgtggacatgaaggaattttttttagggtattggaaatgttccacatcttgacctaggtggtagttatatgggtatatactatataggcaaaaattccttgagttgtacaatgaagttgcacactctatgttgcacttgcgtgtacacacacacacagacacacacacatctaactaaaatgcggtattgtatgctttgcttggcgcctaagagggtcctagctataatgctctaggtcttggaaaagggtccctctattagttgtctgtttttgtataactactccaaaaataaggagcttgagataacatctcacagtttgtgtgggtcaggaatttgggggcaactcaaaaggatctctcatgagtttgcagtcaagatgtcagccgggattgcagtcatctgaaggcttgactggggttggatgattctcttcaagatagctcatctacatggctgtgatagctcactcacatgaaggcctccattccttgctggctgtttgcaggaggcctcagttacatgtcacatggacccctctgtagggctgctcgagtgttcttacaacagaacagctggcttcccccagagcaagttctaatcccaaaggtcaccttcacttcctccatattctattctgtagaagctggtcactgtgtagagtctacattcaaggagagaaaaattaggctccaccttcaaaaggtcacttgaaaaaaaaagatcaggccatatcatagctcaaaccaatgcatctagtgtaactatactaaacattagtttataaggtactagtctttcccctttagcatgttaaataaattccatgccattttgtttgatgtggccctgaactaattgatcagcaaaagatggttctagtgtgacatcagttttgagccaagactgaaagtcatttaaacaatctaagaaatgttttacccctcaaagtctatcagcctcaccaaaggggctctcctgtaccttaaaagccaagaaaaatttcccactagtcaaggcctacctaggacatacctggtcctccatatctgaaggagtgctttttgcaacacagttccttggtctggatgtgagatgaacaggtaacagagagataagcacgcatctattgtggtgagctggcggggaaggaggccatgtttgtgtcccacgcacttcattaggcactcactttacatttatcttttcagaagctggccttccttgctttgctttggaggatcattaaaagaaccattctggctactgttatataccttagagcaatccatccagagttgctcgtgggatacacaattctatcagaaaccaacatgtgatatccaggtgtctgccctaagtagcttttgatttggtgatgatagtagaaacacctgcctgtttttcttgaatcttagtgtgcatggcgtatggtctggatcagtcatcacacaggtacattgtacctctggaggttgactctttaaacctttaagatgcctctaagtatcctccaaagcaaatttcatgtacacaaggtagtgtatgtttagaatcaaagtatcctaaatgtaccacaagcttgaaaaacatttatctagtttttttgtatgatagaaagtgttttattgaaatagattcaattcttacatataaattagagttttttttttaaagggtaggctaacttttgtaactaacaatccccaaatatcagtgacttggcacagtaagagttattattgtttatacaatgccagtgtaggtgttgggacattctcttaaacagccctactccacatggtgactcagggatttaagcccttccatcttggaacatgaacatcttcaatacatgacttacagggcggaaagggaagagagtatggggaaggtaggtcagatccttgactgtctttgcatggagttgacacccatcatttctgcttacattctgatgggcaggacttatcacatggccctacttagatgcaaaaagggctgggaaatgtagtccacaggccctttcttcattcctaccttttcttctactccccaagcctgtgaaatatcctcagatctttgcctttgtcccctaggtatgagtctctccacctgtaacagaggattgtccctgtcctctggaacttagctctggtgtgaagacaagatagcttggggaaagaaatgctaggctttgagtcagaacacagcacacagggaaggaattaattgagaattcttcccaaactgtaagaccactgctcagccatgttatcagaagaacctacgggaaaactgtgtcaatgtccttatgaactgtgggatggtttgctaattccctgtagggaaataagagcagactcgaatttcttgacttttgactggttgtttatttgtgtatttacttttacatgtatgtactgtcatgggatccttagggtgttgctttgccagctggaaacctctgtggctagcagtgcctctgtttcagttttgctcatgcctgctgggctccttctgctcacttggcccatcaggttgcgcgtggctcctgctttcagcccagatcccatacctgccagggtgtgtgagtgagcaagtgcagggtccagccactgcacacagccaggtgtgccggctgtggtggggcaggcagctccaggcgcccgcacaggtgccggctctgtgcaaggctgcagctggaccagacgtactgcaagcagcttctgctgtgggcaccagcatgtggacaaggggaaagcaataacaccagaaaggtcagataccaggaaccacaaagccccaaagagggagttacagcatgtcatagccatgacttggggatccctgaggtctgggctcccagaagggctgcagctcttctctccttctcgtcactcacaatgtggtgagtggggggcatgtttcaggcctgtttgtgttacagctctttcagtcccaccattcagctggtcctgagttcttgtcccatgtccaggaagaatgaggcacgtggataactggagagtgagcaagatagtaaggagcttcattgaatgacagaatagctctgaggagacccgaagtgagtagctcgtttccacaggcaggccatgctgatgagtgtccaggtctcagtggagaggagacccatagtgggcagctcctttccacaggcaggtcatcctgaccagtatgcaagtgtggctgaatccagggattttatgggctcagaagggaggaactgtgtgatgattggtccatgggtggccatgggtgtgcctggaaaaagcaccataaagtttcgctctgggtcatggacaccacctgggactgaaagcctggcccccaggcttcaggctgtccctggtttgaaagtggggcttcactggggacccaccccttccctcctaggaacctgtctgactcctgccaccatcaacatgacctccatggcacccaggctgttcacaccaaggggcacctgcaggcttgcgttaagcctccctcagccctcctggcctcccttcctgagctcgttggtgctcaaagtttcagaaggtgccaaggcagtggaggatgtctggcatgtcagtgctgccctgagcgtgtacacacctagccgggccatgacagcacccaggctcaggctctgaaattggagcgggtgccaggagttgggagaggccagggagtaggagcaggcacttccaagcctgtgggagcttggggctagccatgcccctgagagtacagggatgcccgggtctggagctgtgttgatgtggctgctgctgcactggggagtgaggtgctcttgaccagccaactcggtagggggcgggactcccacctattactgccctcctctggctcggtggaacgcatagccccagcttcaccttccccactgcagctggcatccccacagcagctgctccaaataggccaccgccaccatcagtaccctgggctttggaaagatagtggctgctacttgtacaaacttctcaaaatagactcttcactctagttattgcttatgaatttgtgagtagacatttgtgtgtgtggcaaatttgaggaaagacattgggtcatatgaattcatcatagtgggacataagtcagaactgagtttcacaatttcccagggttatgcaacaagagtcagactagctcagagtctttgaaatattgtagacaactcaaatattgtgtgcatttttctcagaaaaagttacagtatttaaatttttattgtattataacttcgtctaaagtctgctcttagactgaagagcagatagcagattcagttcccctttacatttatccataaggatggtttgtctgtgctgaacgggggaatgggacatcaaccactgcttataaccctgcttataactttttaatgttattgctgggaaatttcattcctgcttgctcatgacttaaaaaaaaattctatttatacatttagaattaccatgacaaaaataggccccctcccctaaaaaaaacccataagtattcataataatatttaaaggagataaattacccaagactgactctgaagaataacccagggaggtgatgattaaaatacttcggccttgtgaaaggagcatatctttggaccagattaatatccttttggcatttatgcagaacagggagttgatctctgtagattctaatttacaacaatgtcaacatttaaaatagactactaataaagacaccaagaacaaacatgcctctaacctgaggtacatcaaataacccttctttggtgttttgacattaaatgcgaataaatagaaaaagggaaccaatattatgaacacatttaaactatgtttaataataattgtatgagcagctcacatcattagcttttttttttactttgtgctgttagtgaggtataactgacacatgtatttaaaatatacagtttgatgagtttacacacacacatgcatccatgaaacttttgcaggacttttccttagttcagttaaagacggggttctttgtcctatggccttgaaaattcaggcttgcagaccattgagtaagatggggttttattgggtaaaaagagagaaaggggggaaacagactctcgctagaccagagtccctgctagagcacttcccacccaccgttcgaatcccaggttccatacaggaagaggagggacagggctcctccccgctgcaaagggcatgaacttcccgaggctccacctcagtgggtaggctggttggagtttctccagggacccccacccacctggctgtctcaaaaccatcaccacagtcaagataataaacatatccaacagtcccaaaagtttcctcatggccctttgtaatccctccctatataccccttctcatccacctaggcaattgttgatcatctttctgtcactatggactagctggcattgtttgggatttaaaaatttatttttgtagagaaagggttttactttgtcatccaagctggagtgcagtggtgccatcacaactcactgcagtgttgacttcctgggctcaagtgaccctctcacctcagcttcttgagtagctgggaccacaggcatgcaccatcatgcctggctaatttttaaagagacagggtctcgctatgttgttgaggctagtctcaaactcctggcctctagtgatcctcccatcttggcctcccaaagtgttgggaatataggcatgagccactgtgcccatccttgaatttcatacagatttatttttttggtttagtttctttttctcagcatggttatactgagggtcattcatgttactgtatgcatcattagttcagacgttttcattgctgagcaggattcacacatgattagctttttttttttttttgagacagagcctcactctctcacccaggctgaagtgtagtcacccgatctcagctcaccacaacctctgcttgccaggctcaagcaattctcctgcctcagcctcccgaatagctgggattacaggtgtgtgccactaccgcccagctaatttttgcctttttagtagagatagggtttcaccatgttggccaggctggtctcgaactcctgacctgaaatgatgcatctgcctcggcctcccaaagtgttgggattacaggcgtgagcctccatgcaccaccccccccgccacatgattaacttttgatagcttgaaacttttagaatttgcccaactccaggcaatcaaaaataatgaaccagtctacctctagtgctgaccatcaacctggacatagtgcaccgttaacatgttaacatgagacttaaatgcaaattgttttccttatcgttctttgcctctaggatgcaaaatattaactagaactgcaggaataatggataaaatggtaaaaatcacctttgccttccaaactagccaaagggaaatgaagacacgagctagtctcaaatattatatcaattcttacaaaatcctatttaattcaatttttgtgttgcgaattgaaaagattcttgagaaaaatattgttcaacatttaaaggataatttggggccaggtgtggtggctcactcctgtaatcccagcactttgggaggccgaggctggtggatcacgggtcaggagattgagaccatcctggctaacacggtgaaaccctgtctccactaaaaatacaaaaaattagccaggcatggtggcgggtgcctgtagtcccagctgctggggaggctgaggcaggagaatggtgtgaacccgggaggcggagcttgcagtgagccaagatcgtgccactgcactccaacctgggcgacagagcgagactccctctcaaaaaacaaacaaaaaaactaaaatttggggctggaaacttcacaaatgtaatgaaaggaagattgggcccttgtacacaagtaaacaaatttaggaaatttcttagggaattagcactcatatagactgggggatttggtgagtataatttatttagatgttaccttttaagaacagcatttttacattatagaagcaataatgttcaaacagaaacttaaatatgaacatagcagcactatttacaatagatataaatggaaacagtccatatgttcaccagctgataaatggataaacaaaatttgtatatccatacaatgtactattattcagtcataaaaaggaatgaagtattggccagatgctacaacatgagagaaccttgaaaacattatgctaagtgaaaagctggacacaacaggtcacatgttgtgttatttcatttatacaaaatacccagaacaggcaaatccatagagacagaaaccaaattagtggttgccagggactggataggataatgggagtgactgatggatacagggttcccttttgttgcaatgaaaatgttctggaactagatggttgcgatgatggcacattgtgaatgtactaaatgccatgaaattttacactttaaaatgctgaaaatggtaaattttgttacgtgtactttaccacaatgaaaagcaatatataccatgtaaaaatttagaaggtatagacaagctcaaaggaaaataaaaataaatgtgcctatctatcaatcgtctatcgtatatctagttatgtctcagtaaagacagaatgttgctgtatgtataatctgtagcctagtttttctcttaatatcgtaaattcacatcatctaatattctttacagtatttttaatgactacaatattccatcgaattaaggaaaaataatttcttaggccagtctcctattattgagcatttagtttatatatattatgaataatattgaaatattcttgtaggtaagtatttgcccacatttgtgattattttctcagaacaaattctgggatgttgaattgcccaggtaaagaatgtaaacatttaaaaaattgatagacttttaaaaaacatttctagagttacagaagaattgaatagaaggtttctgtataccatccccaccttcggttgcccctattattaacaccatacattactatggtacatttgttaccatatgtaacagattaacaaattgatattgattcataatttttaactaaagttcacacttattcaaattaccttatgtattagggttctctagaggaacagaattaatggaatatatattatatactataatatgtataatatatataaatatataaattatatataatatatattatatatattatataaattatatataatatgtaatataaattttgtaatataaattatatatataaattatatataatatatattaatatatataatataaattaatatatataatatataattatatataatttatatgatatatataaatatatattatatataaattatatatatcataaattatatatcatataaattatatataatatacattatgtacataatatatgatatataatatataatatatattatatataattatatatatataattatataatatatataaattataatatataatatatataaattataatatataatatatataaattataatatataatatatataaattataatatatataaatatatattaaataacttggagtccaatgtttgagggcaggaagcatccagcgtgggagaaagatgtaggctgggcggctaggtcagtttctcttttcccatttttctgcctgcttatattctagctgggctggcagctgattaggtggtgcccactcagattaagggtgggtctacctttcccagctcagggactcaaatgttaatctccttggcaacatcctcacagacacacccaggattaataatttgtacacttcaatccagtcaagttgacactcagtattaaccatcacaccttagtttttatctaatgtccattttttgtagttgttcaaggatcccatcgaggataccacattatatatatatgaagtaatggatacattaattaacgtgtatatactttagctaattataatatatataattaataactatatattatacatatatgcatatatataatacaatatacacatatacatatctatctatatatttttttgagacagggtcttgctctgtcgcccaggctggagtgcagtggcgccatctcagctcaccacagcctccacctcctgggctcagataatcctcctgcctcagccttttaaatagctgggactacaggtgtgcaccaccatgcctggttaatttttgtactttttgtagagacagggttttgccatgtttcccaggctggtctcaaactcctgggcttaagccatcctcctgcctcagcctcccaaagtactgggactataggcatgcaccaccatgcccgggcccatgttatatttagctgtcatgtctcagcctccccttggctgtgacagtttgtagactttctttgtttttggttccttgacagttttgaggaatactggtttaggtattttatagaatgttcctcagttagaatttgtctgatattctcatgactagattgggattctgggtttaggggaagatcacagaggtagtatgccattttcatcacatcatatcaagggtacatactatcaatgtgatctgtgactgttgatgttgaccttgatccctggctgtgcagcatttgtcccggtgctcccctgtgaacttcctcctccccgtctccacactatactctttggaagtaagtagctacttctgatatgtgtataattgtgaaatggttaaatcaagctaattaacatattcattacttcacatatttcttgtgatgagaacatttaagatctacgctcttagcaattttgaactatacagtacattattattaactatagtcagcaggttgtacaatagatttactgaacttatttatcctaagtgaaactttgtaccctttgaccaatgtctccccattgttcccctggcaaccaccattctactccctgcttctatgagtttgactttttttttttttgagatggagtttcactctagtctgtcacgcaggctggagtgcaacaatgtgatcttggctcactgcaacctccacctcccaggttcaagtgattctcctgcctcagcctcccgagtagctgggattacaggcatgcaccactgtgatcagctaatttttgtatttttagtagagacaaggtttcaccatgttggccaggctggtctcgaactcctgaccttaggtgatccacctgcctcagcctcccagagtgctcggattacaggagtgagccaccgcacctggtctatgagtttgacacattttagattccacatataagtgagatcacacagtatgtgtctttctgttcctggcttgttttacttaggttgatgtcttccaggttcatccatgttgtcgtaaattacaggatttccttttttttttaaaggtgaaaataatatttcagtgtgcatatttaccacattttctttttctattcatctattgttggacagttaggttgattctgtatcttggctattgtgaagaattctgcaatgaataggcatactgatttttttctttcttttttttcttttagcaatggactcaggctggtctccaactcctgaccttaggtgatccgcgtcggcctcccaaagttcttggattacaggcgtgagccaccgcacccagccaggcagactgatttcaattcttttggttatacacccagtagagagatggcgggatcacatggtagtcctctttttaatttttttgagaaaacttcatactgttttctataatggctgtactaatttacatttccattagcagtgtgccagggttcccttttccccacatcctcaccaacacttgttttcttttgtcttaataaaagccattctgacaggtgggcggtgatacctcattgtggttttgatttgcagttccttgatgattagtgatattgaacatcttttcatttacctgctggccatttgtatgtcttcctttgagaaatgtctattcctgaatagcttttgcccattttttaacagagtcttttaaaatattgagttgttttaggtcctcatgtattttagatattccttatcagatgtatggtttgcaaatacaatatttcctctcattctgtaggttgtctctttactctgttaatttttccctttgctggacaaaagcttagtttgatgcaacccattcgtctatttttactttggtcacttgtggtttttgagtcatattttaaaaatcattgcccaggccaatgttatgaagctttctcctatttccttctactagttttacagcttcagaccttatgtttaagtctttaatccattctgagttgatttttatctatgatgtgagataaaggtccaatttcatccttctgcatgtggacatccagctttctcaatatcatctatcgaagaaattgtcttttccacatgtatgttcttagtacctctgctgaaaatcaattgatgttaataaattcagtcaagttgcaggatgcaaaatcaacatacaaaaatcaataggatttctatatactaacaatgaactatcagaaaaagaaataaaacaattctacttacaatggcttcaaaaaaagtaaaatactttggaataaatttaaccaaggagatgaaagatctgtgcactgcaaactttaaaaccttgatgaaagaaattgaagacacagataaatggaaggatattctgtgttcatggattggaacaattaatattgttaaaatgtccatattaccgaaagtcatctacagattcaatgcaatatctatcaaaattctaatgtcattcttcacagaaatagaaaaaatagtcctaaaattcatatggatccaccaaaagcgctgaatacctaaggcaattgagtaaaaggaacaaagctggaggtatcacacactatctgatttcaaaatgtactgtaaagctaaagtaattaaaacagcaaggtcctggcataaaaatacacagactaatggaacagaatagagagctcagaaataaataccctgataaatttatcttcagaaagttattattttctaaagttgagtactcataatatgagagaacatgacttgactagactgagttttatctctgaaccaggaaacagtggacacatttcaagatgggtaactgtaaattatggcctctcttaaggatttctggagctggttttaatgtttcaaagaatctcaaaatgcgctaagagcagaggggcaagtgtgtaatcccagccttttgggaggctgaggtgggagaatcacctgagcccaggagttcgagaccagcctgggcaacatggcaagagcccatctctacaaaaatttaaaaaattagctgaatgtggtggtgcacacctgtagacccagctacttaaagggctgaggtgggaggatcatgtgaggctgggaggttgaggctgcagtgagtcatgattacaccactgtacttcagctttggtgacatagtgagaccctgtctcaaaaataaaacaaaaggtgtgattgttaaataaaaagactaattttctcacaatctgcgttagtttactagggataccataacaaagtactacaaactgggtagtgtaggcaacagaaatttctttcttcccagttctggaagctggaagtccaaggtgtcagcagggttgatttcttctgagggcctttttccttccttccttcctttttccctccctcccttccttccttccttccgagacagagtctcactttgtcacccaggctggagtacagtggtgcaatctcggctcactgcaacctctgcctcccaagttcaaggaattctccagtctcagcctcccgagtggctgggattacaggcgtccgccaccatgccaggctaattttttgtatttttagtagagatgaggtttcatcatattggccaggctggtctctaactcctgacctcaagtgatccgtccaccacggtctcccaaagtgctgggattacaggcatgagtcaccacatccggccccatgtcatcttgatatagcaaaagaggactggagactgctgcccataggtctcagtggcacaggagggcacccacagtgtcccaaaaccttccttgtggaatgtgatttagcagagaaagaaagagccactgggaacccaggataagatgagaactgggtcgggactgagctgcactctcaatggagaaaacaaatgagagcccctttgtgttccgtgggccacccaggtcctctttcaagggagtgcctaaactctgtgatgcccagaggcacacaggactcattaagaccaagaagtggactttttggataagccattgagagcttaaattcaattccagagtggagggagagggggggaataaaagggagagaaagagttttaaactgaattgtgactgcattgtaaactggaattgactaagaaatgaccgaatttgaatgagtttatctgaaagtgactagattaaattttctctgaggcagaatggaggctcaaggcagaaattacactcaattataaaagaatagagaaaattatatttttgcacactcaagtcagtgactgtgaaatttgtactggctccaataattacaagcggccaggtgtcagtcaaatctctagaatagaccaagggatcattatgtgctgttcttccaagttattacctgatctgtggctgtacctcaaaaggtcaacacaatgtcttatcagaaatcatgatgaaacccattcacatttctcttcgcaatgttctcttgctgtcagaaagtggaaccaagccttgtgaggtggaaaaggtacatttttcagagttctgaggaggcgtaggccgggttataaacctatgaccaaaagagggaaagtaagaaattgcaggtagtgctggatatcttctgcctgcccctgcagaccactgtccccacctccccacacttcttctgggaggcatatccctgttcatggcattgctggggctcctgctcttgagaggcattggcaagaaatcagaggaagagagtgagtttgttggcagtggaaggtatccaagttactggtggcaaatctgtaccggtctgcagcaaccttagttcttgcctcctcagaaaaaagaactcgactgaggggcataaggtagaaaaagacaccaaggcaagttttagggcagagtgaaagtttattaaaaagctttagagcgggctgggcgctgtggctcacgcctgtaatcccagccgtttgggaggccgaggcgggaggatcacgagggcaggagatcgagaccatactggctaacacggtgaaacttcgtctctactaaaactacaaaaaatcagctgggcacctattcccagctactctagaggctgaggcaggagaatcacttaaacctgggaggtggaggctgcagtgagctgagatcgtgccactgcattccagcttgggtgacagagtgagactccatctcaaaaacaaaaagctctagacaggaatgaaaagaaagtattctagcaagactaataaagaaaaaaagagagaagaatcaaatagacacaataaaaaatgataaagggggtatcaccaccgatcccacagaaatacaaactaccatcagagaatactacaaacacctctacgcaaataaactagaaaatctagaaaaatggataaattcctcgacacatacactctcccaagactaaaccaggaagaaattgaatctctgaatagaccaataacaggagctgaaattgtggcaataatcaatagtttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgaggcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgagaaagttcaacaacccttcatgctaaaaactctcaataaattaggtattgatgggacatatttcaaaataataagagctatctatgacaaacccacagccaatatactgaatgggcaaaaactggaagcattccctttgaaaactggcacaagacagggatgccctctctcaccactcctattcaacatagtgttggaagttctggccagggcaatcaggcaggagaaggaaataaagtgtattcaattaggaaaagaggaagtcaaattgtccctgtttgcagacgacatgattgtatatctagaaaaccccattgtctcagcccaaaatctcattaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttgcaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccataaagctaccaatgactttcttcacagaattggaaaaaactactttaaagttcatatggaaccaaaaaagagcccgcattgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggtcataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaccaccccatcaaaaagtgggcgaaggacatgaacagacatttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccagtactgggtatatacccaaaggactataaatcatgctgctataaagacacatgcacacgtatgtttattgcggcattattcacaatagcaaagacttggaaccaacccaaatgtccaacgatgatagactggattaagaaaatgtggcacatatacaccatggaatactatgcagccataaaaaatgatgagttcatatcctttgtggggacatggatgaaattggaaatcatcattctcagtaaactatcgcaagaacgaaaaaccaaacaccgcatattctcactcataggtgggaattgaacaatgagatcacatggacacaggaaggggaatatcacactctggggtctgttgtggggtggggggagggaggagggatagcattgggagatatacctaatgctagatgacgagttagtgggtgtggcgcaccaacatggcacatgtatacatatgtaactaacctgcacaatgtgcacatgtaccctaaaacttaaagtataataataataataaaaaaagtattcttggaggagggccaagtgggcatcttggaggacagtgtctcctttgatcttggactaagggttttatatgttggcatacttccagcatcttgcgtcccttttcccttgactcttcctttggggtgagctgcctgtacgtgtggtgtcctgctagcacttgggaggtgggcatatgcggtgtttaccggagttgtatgcatgctcacttgaggcattcttccctctacctgcaggatgtccctggaaagtcttattttggttaaacgctgcccttttgcctcttattgcacatgttggagctcactcgcccatctcctgagatcttatcaggaagcagctgatcaccagtttcaggttttttctatctgtggggagagttcctttccctggtgctggctgcgactaattattattttagacagttaacaactgcttgaccatcacctgatggttgcctgacattcttggtcaggtggaggcctcttctgccttgctcatgcctgaccagctacctactgtaacaagtcaggatactgatttctctgtcctccctgccagtccccatgggctggctgcagccctctccggaggaccacagcccctatcaggcaaccccattccacacagtcaccctctctcggctccaaaaatcactctctctccttgctttcaggctagggtagtaacatacttttaatactgccccaaagtactgccctttttctgagggtttccctaaactttgcccacacccttgaaaatcatacttttattaaacactttactaataaactgctgcatctcctatagtgttcttggctgatgctttggagatggttatatgctgtatagcaaagctctatgccatctgcatgaacatagggagtgggccatgtgaacgtgtgtgctccaaacagcacgttttcttcacacagctgagtcaagagccctgagtgagcaagactagtgatttctcaggtgacatgcttgcttactgtagtacaggttccagagtcttttgtacatgattctggttgtacttcgagatctttcagctctttaggatcttcagtataaatagtaattattgcaatagatgtgaaaaaaaaatgatagcttatagaaaattctgggtactaaggggttggctattccttttaaagccaggagtgaacatttctaggttaaggatttctattaggaagacaatgactgagaattcacgttcatattgaaagagggcagggagaagtcactcatcataggcagcttctattctgtcagcagtggtatttcaatagagactgtgatctccccagctcctagccaatggtttcctgtttgaagaaagtcccagaggctccaaggctcccctcgcctggatgtgctccacagagtgatacctcctcaatttcttaaatgttctttatgccattaacacaatatttttatttttaaatagatatatgaccttgtcaggagttcaagaccagcgtggccaacatggtgaaaccccgtctctactaaaaatacaaaaaattagccaggcatggtggtgcatgcctgtagtcccagctactcgggaggctgaggcaggagaattgcttgaaccagggaggcggaggttgcagtgagctgagatcgtgccactgcattccagcctgggtaacagagcaagactccgtctcaaaaaaaagagagaaacaaaagacagatatatgaccctaataactggaattttctttctttctttctttttttttttttagcagaagcagcttcctcctagaaactacacagtagtggtttggtcaaaagggcttggaatttattaagagctagaaccatgcaccatgttttgtgtgtcatgctcacttttttagtagggagaccagaaaaatgccaccatggggtattttcagctaaaatgaatgaagttagacgttatctttccaaagacttgccacaaaccatgaagctctgggcctggcactggacagcagttctttccttgggtgtgaagcgatggctgatctgtttgcagaaaagaaaatcaacaaagaccagcaatttgtactgacctcctctgttctttagagcgtgtcagagagcacgatttcaaaacacactgggaccgcaggtctctcattagtcaaagacacccctgcaaccttgccctgggtgatgtggcaatttgggcaaagatgggaagtgttttgccctcctaagctgagcctctggtagtgaccactcccggcacccaaagatactttgtgacctccgatgggctgattgctccctccctctgttcctaccattccggattctaccatatgagataaagtttgtgtctcatagactccacgacatcagtgaagcttgtgttttagagatgcaatatccaattctggaaacagccttttcttggcccacttcaagaagttggactaagcttcaggaaaactgatatagaaggagccccagatggggatgcagggtgacccaggtccttgacgacttgacagtgactctgagtctcctcaaacttcctgggctactttgctgtgaagtgaaagtccaggccccatttatgtttcttcttcctctgctattgctgctggcagccgatgaggtaggtgaagggtcataattaatagtgttcggccttttaaatctggtctccatagcacctccacaatgccattattgtgttcgtgctgcctgtggggacgctggctggtgctctcaaaggaggactctaagggaggcctgctgaagcctgccaccaccaccaggttttctgtaattggatctgcacaggggcctcagggagtgcagtatgaaaacacccatttccatgcactcccaaccaacacgctgaacaatctgtactcttggtgagaaagacccatgagggactgaaaattctttttctacgtgacactgagaagacagtcacatggtttgggtaagtctcactagaaaaccaatctcctgtccatacagccctctgatgaaactcatttctgctaaggcagaggtgagtatcctgaacacagcgtagcattattttagacagatgagtgtgggtttcagtaactggatatataatgaggcaactttgacatattttacaggaatgcaaccttttgtacgtaatggaatgatcagaaagtcagttcagcactccaaacttaaaaggagtattaaaaatgcttcacaattgactttttttcttcttacgatcaatgaatagataatgctacattattatgaactaaagcctgtggtttacattaggattcacttttgtgttttacattcggtgggttttgacaaatgcataatgtcgtatgtccacccttacggtatcatgcagaatagtttcactgcctttaaaagtctcctgtgctccatctggtcatccttcccgctctctttcccagccctgacaaccactgatcattttacggtctccattgtttcacacagctttttcagcctagcttcttcacttaacaatatgcacttaagttttctccgtttgttcatggcctgatagctcattactttgtatcactgaataatattcccttgtatagaggtactacggtttgtttatccattcacttactgaggaatgtcttggttgtttccagttttgtcaattatgaaaaaagctcctactaacattcacgtatcggttctcgtgtggacataagttttcatatcacttgggtaaatgcctaggagcatgattgttagatcatatggtaagactatgcttagctttgtaagaactgccaagtgatgttccacagaggacttataattttgcattcccaccagcaatgagtgaaagttcctgtgttccacatcctcaccagcatttggtggtgttgctgtttaggattttagccattctaataggcgtgtagtggcatctcatggttgttttaatctgcagctccctaatgacatatgatgttagcatcttttcacatgcttatttgctatttgtatatcttctttggtgaggtgtctgttcagatcttttgcccatttaaacaattgaattttctttttattaaattttaagccttgtatattttggataacagtctttaccagacatgtgttttgcaaagattttctcctagtctgtggcttgtcttttcattgtcttaacaggatttttcacagaacagaattgaaaaaatataatgaagttcaacttgtcagttttttctttcattaattatgcctttggtgttgtatctaaaaagtcatcagcaaacccaaggtcacttagattttctcctatgttatcttctagatagatgttttatagttttgaattttacgtttatgtccacgatccattttgagttaatttttgtaaaaggtgtaagatctgtgtctggattcatttattcgtatgtggttgtccagttgttctagggccatttatttaaaagactatcctttttttccattgaattgtctttgctcctgtgttatcagtggactatatttgagtgagtatatttctgagccctttattagattccattgatttatttgtgtattcttctgccaattccacagtcttgatggctgtagctttgtagtatatctttaagcctgtagtgtcaatcctctgactttgttctttaagattgtgttagctatttggggtctttcgcctttccacagaaacttcagaatcagtttgtcaacatgtacaaaataatttgctggaattttgattgggattgtgctaaatctacagatcacgctgggaagaactgtcattttgacattattgagtcttctgatccacaaacatgaaatatctctccatttatttagatttattttatcagaattttatcattttccttatatacattttgtacatattttgttagatttatacataactctttctctctctctttttgatgctaatgtaaatggtattgtgttttaaatttcaaattcccattgttaactgctggtatatacgaaagcaattgacttaaaattttattttattttatttcaaattttaatctgtttatttattttgagacaagttatgttactggctaatttttgtatttttttgtagagacagggttttcgccgtgttgcccaggctggtctcaaactcctgagctcaagtgatccgcccaccgtggcctcccaaaattctgggattacaggcatgagccaccatgcctggccacaactgactttggtatatcagtctaccttttaaatcccctctttgcctttttctttcattgatttcttctgtctcttgaaagagaaaatactcagggtttggaaaaaaatatgaaattaaatattttaaaaattagactttatttttaagtttatagaaaatcgagccgacagtatggagaatccctatgtgccccccaacagtttcctctactgttaatatcttccattagtgtgatacatttgttgcaaatttaaaatttaagtttaatgcagtaagtaggtattgagtacttttaggcatgaacaagaaatgttccctacccccatgaagttcacaattccactgagaaggcaggaaaaaaatgctgtcatatgagccattaatacaaaataatgcacaatttggttttaaggtgtgtcctcctgagcaaagaggaaggctctggaagtgaggtaggaatgggataagtgcaggtagattacaggcaaagtccaagcagaaggaaaggcctgtgcaaggttacagaggcaggaatgttagagggaggggcttagcacatatcacattgggcagaggtgggaagtgactttgaagagcaaacaggacagggtccattgtattagggtgctttagagggacagaactaataggatagatgtataaatgaagagggagtttattaggagagttgactcacacgatcacaatagacagcctgtaagctaaggagcaaggaagccagtccaagtcccaaaacctcaaaagtagggaagccgcccaagtgcagtggttcacacctgtaattccagcacttcgggaggcagaggcaggcggatcacctgaagtaggagtttgagaccagcatggccaacatggtgaaaccctgtctctactaaaaatacaaaaattagccaggcgtggtggtgcatgcctgtaatcccagctacctgggaggctgaggcaagagaatcacttgaaaccaggaggcagaggttgcagtgagccgagattgtgccactgcactccagcctgggcaacaggctttttttttttcccccccccaaaacaaaaaaaaaaagaaaaaaaaaaaaagtagggaagccgatagtacaatcttcagtctgtagctgaaggcccaatagcccctggcaaatcactgctgtaagtccaacaatccaaaagctgaagaaaatggagtctaatgttcaagggcaggaagcatccagcatagggggaatgatggagcccagaaaacttagccagtctagcctttcaatgttcttctgcctgcttttatcctggccatgctggcaggtgattagatggtgcccacctggattgagggtgggtctgcctctcccagcccacggactcaaatgttaatcctttgacaacaccctcaccgacacacccaggagcaatactttgcatcctttaatccaatcaagttgacactcagtattaaccatcacagtccttcatgctgctgtgaggaatcaaaacttgataaagggcttagagttgagtttctgagcagatctttaggatctggttttcccaggaccattggtttttggcttcacatatatctcaagccagatactctgcaccgtttgcttctttgaatcaaaattaaaggctcatgccaaggagaagcactgcttctgggggagagctaccaaatgggaccacggctttttcatttgccacaagggtagaattttgtgtgtgcacataggaggaaagcaaacagcttaggaggtcataaatagcaatatggaccctacagggaaattgccctgagttctccaggcccctttcctgggttgaactcactctccttgaaggcctttgtcatttctggtggtcaggaaaaccctgtggggtctctaagaagggaggaaagcaatgagggaactgaatgaaccctattgctttaatctcttctcactactaggggaagagcaaggagggcataaaataccctatttttctttcttggtcttagttaacttatctcaacaggcgtctctagatttacatggaattgcttattcaggtcatcaatgagactgcagggacacgagaaagttttgttagtgaaaggacatatacacaactttggtcacacctgccccacgaacatcacctgccttcacaatctctctaggtatccgccccttctctgttgtttctttgcccccactcctactgttgccacctgagttcaggttgcccacttgactgcaagagcacaagggcagccaccaactccctggctctcgtccctctcacagtcactgcgttcaaaacatcagaggcagcttagagccattcttttcccatacaaggtgtctcatcccttctctgaagcaccgcatcacttccttttcttttcttttttttttttgagacagagtctcactctgtcacccaggctggactgcagtggtgccatctcggctcactgcaatctccgcctcccaggttcaagtgattctcctgccttagcctcctgagtagctgggattaccggtgcccaccaccacgcccagctaatttttatatttttagtagagacagggtttcgccatgttggccaggctggtcacgaactcaagtgatctgcccacctcggcctcccaaagtgctgggattacaggtgtgagccactgcgcccagtacaccacttcctttcggttcccaccctgccccaggacctcagcaccctccctaaaactcccccatatattctgcatcaagtctggactcttgggcctggatttcaagatgttccctctcaaaacctaccagcctgtcccgtgccttagtccactgctgctcattttacccctgggcctggcattttttcctccttctccctccaaagaacaatttaagttctaccttctctatacagggttgccactttgagcatataaaatatcagatagttggttaaattctaatttcagatagataaaaaatgtttaaaaatatgggacatatactaaaaattacttattatttatataaaatttaaacttaattagacaacctatattttacctgtcaaccttatgtctacaaagcctgttcttaatgacccaattttctctgatctcctttttttagtttctaaaacacccaatttagtctttaattcagtatttcattctatgctattttatacttattaattatatatataattttaacacttattgagtaattattcaacatcagggagtgtgctaaattcttttcataccataacttacattcttataagattcgtgataaagtaggtactgctacaatacccatttcataaatgagggagctgagtttttgagaggttattttatttatttaaggttccaaagctaattaagaacttgaatgttgatctgtctgtagggtgaccaacttgtttcaattttcgtggcactgctctgttttttttttgtttttgttcctggttttgtttattttttgagatggagttttgctcctgtcacccaggctggagtgcaatggcatgatctcagctcattgcagcctccgcctcctgggttcaagctattctcctgcgtcagactccagagtagctgagattacaggtgcccgccaccatgcccagttaattttttttttatttttagtagacacagggtttcactatgttggccaggctggtctcaaactcctgatccacctgcctcggcctcccaaagtgctgggattacaggtgtgagccaccacaccccgccagcactgctctgtttttaaactgaggcccgcatcccaggaactccctcagtcctgggcaagccctaaacatctgacttcaacattgagattctatcttacttctcatttttcatgggttttaattgtgttctctcagctagactatggactccctaaggaaagggacacgtcttatggtatttactcatactaagaattacttagtaagtgcttgacaagtcaggagtaggaagatccttcacagaccaaatctcttttctagggtctctttgtttttgtttgtttgttttgagacagggtctctgtcacccaggctggagtgcagtgatgagatcttgtcttacagcaacctccacctcctgggctcaagtgatcctccagcctcaacctcctgagtagctgggactacagacacatgccaccacgcccagctaattttattttattttttgtattttctatagcgacagggttttgctatgtggcccaggctggtctcgaactcctgtgcttaagtgatccacctgcctcggcctcccaaagtgctgggattacaggcgtgagccaccacgcccagcctctggggtctctttggattgtaggagctgaggactgtgtggagctcatgcttgggagtggccagtctcagattcagctgagacctgagtatgacgaagcctttgcaatagaggcacacatgttttcatgatgccactggattctgcttgcaaagatgccaggcgattgctatcagcaacaatgcctctaaattgctgaaaatgcagctccctggtaggtaggtcacttgacaagctgagccttgagaggcatcctgctgtgaagtctgagttagggtatgggtgaggctggagaaacagaagtcagggtgctaggacgagcggggtgcaagtgggcggcaagccagtcagcaccttgctggatgggacagcaccgtaggaagctgtgtggctgttgtttttttgctgggactctgcttttgtccaatgggcacatatccaaaagattatatattattacattattacataataaccaagtggttaaaatgatgatttgtgggtgttattgctaggctgcaatgtgtttaatgaggtgtgataggaaaggcagaaaagacagatttccatccctcaagggtgtgtggctaacttgtctcaacttcattttaaatgccggttggtgttgagcacacattaaatataagaactaagctgtatgtggagaagtcatctgtaaacaatcatttgctattttaaagaaatctaagttgaattggtaaaagaatctcaaggtaactgtcttttctgttgctccatcttacttcaaagtgcttgaagttttttatatgcctttaatgttcaggttttttctttaagagaatgtaagagacatggggcacaaaggttaggcaggagtttccattttgaaccgtgctgacagactcctcagtctttctctctttagaaacccatgctgggttttccctgtctccagagggcagcctctccatctcagtgtaacattcaaggccattcctggcctagtctggctccagcctgactttgcagctcatctcctaccagcgtcttaccatgggtctgctccagctagactgctagggactaaatgtttgtgtacccccaaatcatgttgaaacctagtccccattgtgaggggtttttggaggtgaggcctttggaattaactgtttttataaaagagacctcagagagctcctttttccttcccccatgtgaggctacactgaaaaatggctgtctgtgaaccaggcagagggcccctgccagccactgcatctgccagtgccttgatcttgggcttcctagagtctagaaccatgataaataaatctctgttgtttataagccactttgtctatggcattccatgacagcagcctgaaaggactgacacaggctcttcgattaccatcatctaaatacacactgaacttttctgcctcttaagacttttctcttgcaaggtatcatggtttagcatttaatcttttttttttttttgagacagcatttaatctttggatctagactgcataggctgaaatcttggttcttctatttactatgtgatcttggataagttacttaactgctctatgacctgatttctccaactggaaaaaaattaaaatgatacttatcttatagaagtcaaataatggaagtacttagaacaatgcacatcgcatagtttaagtactcagtaaatgctagctccttatttccataactagatctcattacccttctcacgtagctcaaaatatgtctttcccttgaagactttcctgaccaccccatcctgcaatgtacttccatcttgagaaatcccgagttctggcactgttctttggtgggtgggtggtttctgttctcatgcttgtgtcttatgatcacagctattcattgagcactcactttgagtcaggcttgtatgacacttggaggcacgtattctttatctcactttatagaggaaccaactgaggctcagggaggttaagtgacttgctagggttgcagagagaggtgattctggggttccaattcaggttccccacacttgcaaccatgacactctctattttactaggaaacaaggagtgaatcttgcacttgattccagcttccatactgcttttcaagtagaaggcactcaacatattgctgatgatttgatgggtcagtatgcaaactgttgtccttgtaagtgccacccagtgccttctggttgtgatgatcttgatgataaagatattgcatgatatattttgatgggccttaaaaaattagacaatagcttattcttcttgtgttgaactctacgtgaattaaaaaacaattctcacttattttttaccttaactatcccctgctgtttcaaatatggttaggtggggaatgtcaggaacaatcttattatgaatgctgcttttgtcacaaaggagactttctcatgactcagtaccagctaattagtctgtcagtggctttctttggcgaggagagtcatttgatccattgttgacaaggtgcaagctgctttctacctactctgtggcagctccaatgggtctgacattttctcaacccctaatcaagatgttattaagcttctgatggtttacagccaactgggatgagagtggattggttttgtaaacaactgccagaaagacaactcagtggtactttagcaatatgtaaacgcctcagattttcctgtgtgtgtgtgtgcatgtgatacaaaggcagcttctgtgatttctaaattcctggaacatgatagtttttttttttttttttttttttttttttttgagatggagtctcactctgtcgcccaggctggagtgcagtggtgcgatattggctcactgcaagctccgcctcccgggttcatgccattctcctgcctcagcctcccaagtagctgggactacaggtgcctgctaccatgcccggctaatttttttgtatttttttagtagagacagggtttcaccatgttggtcaggctggtctgaagctcctgacgttgtgatccacctgcctcaacctcccaaagttctgggattataggcatgagccaccacgcctggctgagactgaaattgttttttagagatggggtctcactatgctgcccaggctggagtgcagtggctattcacaggcacagtcacagctcactgcatcctctatctcctgggctcaagcgagcctcctgcctcagcctcccaagtagctgagactacaagcacatgctgctgcacctgactctgagactgaaatcttcaaaaaccctggcccatttaatcaacacacatttattgaattagtactatgtgccagatactattctaggtacttaggatatagcagtgttagaaatagactacaattcctgccctcttggagtttcttttttttttttaaagctttctattatggaaaacatttcaaattcctataaaagaagaaagaataatatacagtagttccccacctctttatccacaggggatatgttctaagattcccagtggatgcctgaatcaaatcctatatgtactatgtattttcctaaacttgcatacctatgataaagtttaatttgtaaattaggcacagtaagagattaataataacaactaatgatgaaatataacaattataccagcatcactacttttgtgctttgtggccatcattaagcgaaacaggggttacttgaacacaagcactggatggcctgacagtcgatctgatcaccgggctggctactaagtgactaatggataaggagcatgtacagtgtggaggccctggacaaagggatgattcagatcccaggcgggacggggcaggatggcgtgagatttcatcatgctactcagaatggtgtgcaatttaaaacttatgaattgtttacttctggaattttccacttaatattttcagactgtggtggatggcagctaactaaaaccacagaaagtgaaactgccgataagagaagactaccgtacccaccattcagctttaataattatcaatattttattctttttacatctatccctccaccacacacttatttttaagggagcacattaaagcaaatcccagacctcaaacatttttcatacgtacttcagtatggatgtctaacagacaagaatttttaatagaaacatgaccatcatgtcatgatcatcatacctcccaaaattaacactattgaaaatataatttaatatccagtctaggctaaatttcccccatttgtctaaggaatattttcacatttgtttgtctgaatccagatccaaataaagtctggacattgcaggctgtggatggagctcttatgtctctcctggtctataaccattcccctcagccattttttggttgtcagaattgggttatttgttctgtagaaattcccacattttggcgttggatgattgcatcctcatggtgttttttaaaaaatgatttttattatgccttacattttctataaaataatagttatttctagaggcttggtcagagtccgtttcagtggcaagtgctggggagattgttggactgacatcctcatggaaactggcttgtgttatttttgtgtgccaaagatgcttctggaggcgtcttattggccaaaaatttggggggtggctggtacccgaaacttagcttttgtgccacagtggcaattttcatcctaatgccatgtgacattccttttgttccgtcttcctttatgtaggctttaagaagacttcaattttttttaaaaaataaaaatacatcataattgcatatattcatgaggtacacagtgatgttgcaacacatataatgtatagtgatcagatcacagtcattagcacatccatcatctcaaacatttgtttctttgtgttgagaacattcaatatcctccttgtagctatttgaaaccatataatatattattgttaactatagttatcctacagagttatagagcactagaacatatgcctccaatctagctgtaattataaagaagactttgcatcatgtggtgtctgagagtggcagcaactggagggtctggggagcagtgccccatgtaggaacatgcaaattcctttgttagtgtcttctcaggaactagggctaagaaaagggaaaataaatttatagaatagggccggcatgacagctcatgcctgtaatccagcagtttgggaggctgaggtgggtggatcagttgaggtcaatagttcaagaccagcctggccgtcatagcgaaaccccgtctctactaaaaatacaaaaattagccagccatggtggtgtgcatcagtaatcccagctactcggtaggctgaggcaggagaatcgcttgaaccgaggaggtggaggttgcagtgagctgagattgcgccactgcattccagcctgggtgacagaacaagattctgtctcaaaaaaataaaaaaagaataaacatagaatagcatgaaactaaactagatcaactgaatggaaatatctgaggaggtctttaagggtttattttgcaaaagatatccaggtgattctaatgcacaaccaggaatgagaagccccattcagataataagtctcgtgcggctcaatggagtcctcttcagtttgtggtctacttcagcaggcagtccccacctgcaaccttgacaaaggagatggattagaggagggcaagcccaggtagaagcagtaggaggttcctggggtctccagtggctactgatttgtaaggatttctatggtatgtgaatttacttaataaatgatatcataaactttttgaagaatgaagacagggagtttggtttggagaatccaaaaatatgataggaagaaaggatgactccagtgagcaaaaagaagaatagagttgccatttactgacatagggaaggttatggggaagggttccattttgaacatgttctatttgtgatatgtaatgtatgctgtagaatggatgttgagtaggcagttggatatacatctgaggttcagggctggagatagaaatttggaaatcaggaaaacagagatgatatttgtttatttattattattatttgagatggagtctcactctgtcccctaggctggagtgcagtggcatgctctcagctcactgcaacctccacctcccaggttccagcaattctcctgcctcagcctcccaagaagctgagatcacaggtgcacgccaccatgcctggctaatttttgtatttttagcagagaccaggttttaccatgttggccaggttggtcttgaacccctggcctcaagtgatccttcctcggccactgaaagtgctgggattacaggtgtgagccaccacgcctggtcaatatttaaagccatagactgaataaggtcacctagtgaatgagaaactgacttcctggaaactgcatgaacaaggtgcttatagaaccactgtaagggtttctctgaggcatatccaggagggtgactgctgagtcataaagcatactgctaatttttttcactaagcactgccaggttgatctgcagaatatatttaccagtttaaatttccatcagcagtgcatctttccccagatctttgccaatatttgggattatctttctgatttctgccatgctggtgggtgaagcagtggtgtgttgaaaacagttcatgagagctgataaagcacatttcttcccaacttcttgttcagtgacctcaagctacactggtagctggaaactggcagtgctcagagtatttgcaccatggaaattggcaaacactgtacgttaggacttttccttccctggggagcgggttttaaaacatagaccagcatattggtggctatggggtcacactctttatattcccactctgattacaagtggggttgagcatctctttaatgcttgcttgccattctggcttttccttctgtgaattgtctattcttatacttttctcatttttatattggcctttaaaatattttatattgacttccttttgatttgtgaaaagttcctcatgcatttcagatattaatccctagttgcttttgaacatagcacatgttttcttccaatttgtcagccatctgttaattttttctatggtattcttaactgaacagaacccttaattgtgatgcagtcaagtcatacaatttttttttgcttcaaggattgtgcttttgcaaacctgttttatgaagtaaattcctaacccacattatagagatagtctcctgcattttcttttgtatcatatgtaggtctgccatttatctggagttcacctttgtatatggcagaacatggggctctcaactttatttttccttgataaattaaagccagtttcccgaatgccgtcttctaaataatttatatttttctcattgatctgtggtaccacctttgtgtaaatggaggtagcatttatacgtgggtctgctcctgagttcttcattctgtttcctatttgctctatgtgttcctataccagtaccataatatttttattactatgtggcaatgacataatatctggcatggcaggtctgctctggtttttataattgacttaactgtttaaaatttatttctccttatatattttgtaagtttgttgagttccctaaaaatttagtttctgctggaattttggttgccataacatttactttggagactaaatggatacttttacaatgtaaagtcatcctatccatgctgtatctctccacttattcaatattttatgtccttaaatagagttttaaaattttctccttaaagtttttgcaagttgttgggttaattcctggatattatgctttagagtttgttaaactttattgttattgtgaatggtttcttattgtctgttacatttcccagttgcttactgctgatgtagacaaaactattgatttttagaaactgatcttgtacttggcaaccttgctgagctaacattacttctaatactttgttgattctgttgggctttttatgctgatgatcacacctgtaaacatcacagacaggaagatattaggggctctgcccagtgctctgatcttttgcatttaagcacttctgctagttgaactccaatctggtgccccaattctgacagttgggtgtctctcatggtcctaagggcctaggccccctatacactcacaaattagaaactgatgatattccatcccatatccagtccatgtaaaagcagtgaccttgtcttcttttgctatttcctctaacccttttatcatggtcggggtcctgagagctgctgacagatcttcctgctgccgagtgtctgaattcctgaatgctgctctatgcagccattctgggtctttaatgcccccaaagacagcctgtgtaggttagcaaagtagtgaatcaacataggccttcagatcagacagacttaggtttgaatcttatttctgcccctggctacatggagcaagtcacgcagcctcccagagtctgcttcttcatttgtaaagtgaagacaagatttccataggtcaagtgccttacagtggtcagtgagtaatgccctttctccacactgtgatgttgaccagtaagttgatcacctcctgacgctgtggattattgctatacttttcaggaactttgtgtctccagatagaattgaatctcagcagctacagttggtccacatccccatgtgccttcccaccccaatgaatagttcaagttccaagttctggccacatatcattgtccagtctcactctggttaactgggcaatacctggttctaaagcttgtatgtcacgaggtattctaggaagcatgactccaacgagcacttgcattcttgatgatggtataaagaagtaacgtcagatttttgaacaaaggcaactaagtgagtgggagactctggtggcttggtatcctgggaatttgcctatgtatcatacagtgtttgggtgtagcagataaagccagtggcctggctggttctaacagagatctttattataactaagaacaactgagctagccatgccttgtcacctactaatagtggtatttcagatggataatttaaatcagcaataaaagtgaactgtatacgtttggaaacttcaccaatagctactctgttacacacagatctttatgactttctgtggttcaatgacaattggcctcatttataggtgcttgaagccaaccaagggcagattgccttccttcttttaaccagctaaagagatgggtgggtcagacaagaagagggtatgatgaaagcagggaaagggaggtggactcttcagagggaggaggaagtatccgtgtcacattatctctgagagcactcgcagatgctgagcctgcagagacagagaaactggcagctgaccagggtcagggatggtcatgtattcaaatattgtgggttttagtcaagtgtgctccacccgattcaacaatgtgatgtgactgctcctagcaactattttgatatggtgaatgttgttaagcataggacctaagaagaggtggcagtctctttcctctccgcacttggcaggccacccactcattcctgataatcacatttaagagagctctggacaagctggaatgcatccaagagaatccctcaacatgctggtgagtgggattgtgaccaggtcatatcaggagtagcctaagggacaggtaatgtgtgtcttggatgaattggagtcagacttaagagtccccagggcagaaacaaaatccagtgagggagagatgcagggagctggattttagctcctaaggtagaaaatttccaaaaggctgatcaaagattaaatggctgccttaaaaggtaatgagttccttgttagtggaggtgttcaaccactgcttggtgggaagacactgtaaggaggattcaggcaagtgggaagggggctttttccagtccctgaaatcaatgattctaacaggaaaagatgctccggggtgcggtgagcgcttacctctgctcttgcagagacactgacagacgttcattcaacatctgttcctgccaggcactgtgcgcgctgaacacagaagtacagcctctatgaagcagccgctgtaggcctcagagacagctgatagatgtaacactgttgtctccatgtttcaaacttcggtcatggtcttactaggtctcctcattaaggggactcactatgtgtccagtaacgctttcttgttaccagatgacagagagtcaggctgtcagagttcacgactttaggtgcacagtttcaccctgtctggtccttgggagacggagaaggggtcaggagaaaacgtgggtgaagaggcagcaaagccgcaggagatatgaactaattgctcaacgtgggtgtagcacggattaggccttttacagcaagcgctgccagcagggaactggtggatgtactcttgaccacgctcggctggactctggggagcccaagacgggtaagactaggtccccggccccagcagctggtgggggcgccgcaggttagagacgtgaggccgcgaggctgagggctgtgaaggcggtgggcacgcacggcgtgccggggccgcctggcttcgcggcgggggaggtaacactgcgacaccccgcagacgctgtcagccggggtcgcggccccgcgtgcgcccgatcatctgactgctggggagtgcgggggcgcgggagccaggcgagccagcgcaggcgcgcgctgcctcctccgtccccaccgagtccccagcgcgtgcgcggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtgggccgggggcgcgcggggcccccccgggccgcgggctggccggcggcggggttggggccggggtgggcggccctgggggcccgcggggaggtcagtggccccgggagggtcgcgcagaggcgctgggggctgtggaagccccgcggccgcctcccgtgggcaccggtgtcgctggccgcggggaggccttctcggggcggagcggcccacccggcggggatggggactcctcgtggcggccgctgacggacggcccaactttaggttgaggggcgcggggtgtgcgggacccggcggcggagctgggctctgggccacgaccgccagccgcggctgccccgagagtccccgcacgcgcagtggctttccaacgcggcctcttcccatttctcacttgactccccttgcgcattaaattgtcgagaaacctttggccagtgggtcttcaaagctaaaccaaatggctgtccttgcagtccttggctacctgagatcccttaattctgaaccatccgcacctgggaggggaagttgaaaggagcgctggagctgagcccgcatccttaaggatcccattcactgcttatgatggtagagctttgaattagatgtcaggctgttcacgtcatccagactctggttttcagctctgtgctgagacagtgttttgatacgtatcagaggatgatgttcctatgggacaataacttgctgtatgttctgagatactagactgcgttcatattgtagcaccatcatcgtataaaacgggcgcctttgaaaggtttcagtaaacaccttcctcaggaacatccgccagcacttaaattgtacttcactttcactttgacgtttgttgtttgtgaatcttgtgcacaatttaaagtgagtcgtctaaacagcacaggatcacgtggtgcggggcattgagcaactggggaggaaagcagagacttgaacctgctggagtctagttggtctgcgtttttatgttggagaaccatcctggttccagcttattttgctttcgtaaatatgatgcattttttaaatgctttcatttgatacggtctatctggactgtaagattgagtctagccatgcatggaatgtgtttacttctgttttgtagaagatttagcccatggtattctatttgtaggattcatttcagacattttgtgtttaccacatacagtcccaccagcaagggcttttaaaaaagtgacctatgttgtctctcatagcttatgacaactccaattttgacacgtgtttgaaactagtgatctttagattatataaaatcaacttcactctttctccctgttcaaacctcaaactctggttacttttaggcttactgctcccttgttaattatttataatgaactatggagctataggcttgctttagtgtgttaacctttatttgtgtcttgtttcaggcatttgtatattgttttctcatctggagagtgagctgcactgttttccttcagtgctgtttagaagagctttcggagaccagaaacatgttctttttgcattacccaatatggtagcactagccacatatagcttttgaccacttgaatggggctagagcagtggaagcactgaaattttaatattttttttcttttccttttctctctctcttttttttgtttttgttttttttttttgagacggagtctcgctctgctctgtcacccaggctgcagtgcagtggcctgatctctcctcactgcaatctctgcctcccaggttcaagcgattgttctgcctgagcctctcgagcagctgggattacaggcgcctgctaccacaccctgttaatttttgctgtggggtttcaccatattggccagggtggtctcgaactcctgacctgaagtgatctgcccatctcggcctcccgaagtgttgggattacaggcatgagccactgcacctggccaatttttaaattaatttaaatagtcacatgtggctagtagttagctggtcagatgccacagctttaacttattagtctccaggaagccttcgttgaccctcttgaatctgtgctttcataggactcagctgtccttggtcatagcacttactactttcaactttctggtaggaatcaacactaggctgtaatttatatgagggcaaggacagatctggtttctttacctttgcatagcttagaacttagtaagaaaaactgaataaatatttgttaaatgcataaatagctttttcagggcaggtatttcaatttttaattctctctaaggccaactaagtgttcagtactgtaaatacctgtttagtagattgtacagatgttatgtaggtagcaaataaaaggatcattggagttatgctttaaatacttacgtggtgagattggaatctcaggagaatgatgactcataacaaagtattacaggaaattgaatgaaagggcctcatgattccagctaatgtagacacagctttggtctcctattagttgaataactcaaggacactcttgaaccatatctcaaatctgaagtctcctggcttcagtaaggcccttttatggggtccagacagtcctgaaccagcctgaagatgctagtggacatccccatttattactgctctgtgttaaagcatggaccaaggagtcttggaaaaaaaatcacaaggtatttgagccacgttatgtaagatgcttttgctaacagctaacttggagtgatgagtagggtgaaattcctatagaaatcagagtttggggaatttgattctagctattgttagtatcagaggcacctgttctgtagacagttgattagtgccaattttttttttttttttttgagatggagtttcgctcttcttgcccaggctggactgcagtggcgggatctcggcttaccgcaatctctgcctcccaggttcaagcgattcttctgcctcagcctcctgagtagctgggattacaggtgccctccaccatgcccagcgaattttttgtatttttagtagagatggggttttgccatgttggtcaggctggtctcgaatgcctgaccttgggtgatccacctgccatggcctccgaaagtgctgggattacaggtgtgagccaccatgcctggcagggccaatatatatatatatatttttaacctgaggcttactttataatcagttatcaccagttaaccatagttggatttggaatgaaagtgtgtactcagttcagatcagtatacttagacatttgaccaagagtccaggtgttgtaggtcttcagatccaggaattgcttttaggaaatgaatctgagactataaggaagtttataggggtacatagtttcctttgggaggacaaaaggtagaatgttaagtttttcacgaaaataaggaaatgtaactagagaaaaacgcaacaaagacaaaatacaaagaatgttcactgcattggtcaggtaatattgtagcttcttctggacttgaagtatctaatatgtaaaagaatgaagctggttacatctgattgcatgaatcctctttccactttgaatctaagctttgaatattagttaaatatgtgtaacacactattctagctcctgtggtgactgctagttgtgtacgatagagttcgtatctttgaggatctcaacagtttacaaggaaatgaaaggtgctctggggatcacttaaaatttttttttttgaatgggagactccaccctttgaaagggaagtcatgtggtgactcctcttaaccgactcagacagatatccactgaatctttttgctgaagaattaagagtataaaaacatgtctgagtcccaaaccgtgattatagtcagattaattttcctaaaacagctttaatcatgttactctctttaaaaaaatcagtagtttcccagtgctcatgaaagtaagtggtttggtctttgatgaggtatttgctcctcagtacagccctaaaaagcccttacagcctcacctctgactgttttcctagtcatatcccaagttccagcctactgttcttttaatgggatccccttttatattgatacctattcatcattcaagactcatcacagatgataccttcttcaccatttatgattcttagaagctccaactgcaaatgttcctggtacttatgtgatggagcagatcccattctgcctcataatctatagttattagtggtattttattcaccttaatagattgtaaactacctaagaagcatggaccatctgttaactcatttttgtatttgctgaaacatctagaatagtgtcttgtatatagtggttccttaataaatactcattactgtttggaattgatagtatttgaggaagatcaccgctgctctataacactaattccatgaacttgtcattttcctatttatgtggcaaggttaatgtcaaaatgcttctaagtatttggtggtaagtaattttagcatccaagaaaatgtgaataccttaaaatagtaacaactggattaggttacctaatatataacatctatatccatataagcatacgatttttgaggaaaaagaaagcctcctactttttaccagttcctgccagtattaagaaaacatgaatcaagttaggaagacaacagtgagctcaatgaaatgactgttttattgtagtggggaactgatggtaaggataattgagttagatatagggttggttaagtagaacagagcacacattaagtagtagctagtatggtgttgtctactaccagatcaagccattgattacctatttttattctgtgctttctactgaaataatctaaactcatttttcatttagttttataatgttttgcttacattttaaaaacaggaattcatgatacttcagatagtaaagatcggatacaaaagaaactggaaggcttttagcttcataagtttggttttactagcagtttctctgctttctacatcatttctgagatgtaggctagggtgtagtacaaagtctaatttagagcaaatttattctaagcactcatgttttctgggaaaaagaggtaatataagccatgtgctttaaaaggcatggcttccatctttggccaggatagaactcacatacctcggaccttgttaagttgaacaatcttagtaaactcttagatttgtaagagggatatgattaattttcagtaaagttttctgggatagaaaataatggaaacattttaaggtagattatcttcatgtgatgagcacatggcatgagctattggatgacaaatgatgtaacttgtgccagtgttatgggaagttaaagatccatctacaagggttaatacgcccttgtttgttacatgagtaggaggatttcacccatttagattagctcagcatttaaagtgttttcacctattttatattccttttgagctttgtctagagagattacatgtgctaccgactggtataagaggtggtgtgaagcaatgtatgccttttaacaacagttttgccaaaaggaattttttccctttcataaaagatccttactgaaaatgtcagcagatttgacgtcaaataacttttaggcagttattgaaggcagtcattctaagttgcatacaaataaagtagaaacactttttttttctttcttattataggtggctttctagaagatgaccatagaggaccttccagattttccattagaaggaaatcctttgtttggaagatacccatttatattttctgcttctgataccccagttatcttttccatttctgcagcaccaatgccttcagactgtggtatgtgaagtagctgtgcttattttctgtgaactggtaacttgacttctctgttacgccttttttgcactcatagtctttcttagaaccatttttatggttttcataaaattgctaaagttttcctttttcaaaaatacaattgcttattgctttttctgcttcttaagctaaatgctttatttctgctgtcagcatttatattatgttaaaatgttcattttaagcatcatgatggatttagaggactttatttttagaaagcaatggtgcttagatatctagcattcttctgctattgatgtatttattttggttaaatatactgacttgctaaaaaagccatgtacttaggcaaagagggtaagagacccttccctggaatgtgaaatgagattggttaatgtttaaattggtccatttacatctcctctgtaaaatgttaatttagaagcattccacttctcatctatttaggcttatttctccagaaccataataaaagggaaccaggagataaatttgatagaattgttaaatttccagtttagagtttttcaagtaaaatgttggttcaccatttcaaattgtttttggaggtagagatcatacaatttttacatattagtagatattagtagatataaagttattggactgagaatttgtctttttagtcatattcgttgtagtatagtaattcctcatctccaagtttctttttttttttttttgtattcagattctttagcagcttacctagaccagtcgtcagaagtattatataaaacctgtgccttgatcttgggagttatctgcaggttttgcagtaatcaactgggcttattttcagatataacaaaatcagttatgcaggggaaaccttgaaccttgtgcattgtaccttaggtatgatacttgtctcactccatcttgacttctaattgtcttattttctttcctatattgtagcgctttgggatggagaacaatcattttatttttgtttatctcaaaaaggctaatatagtcatttgttattagttgctcaatgattgttgaataaatacattgaatgaaaggtaataatggatattgacattttgcataactggaattaaacgttgaaaccccgtctctactaaaaatacaaaaattagccaggcatggtggtgtgcgcctatattgtcagctactcaggaggctgaggcaggagaatcacttgaaccaggaggcagaggttgcagtgagctgagatcgcatcactgcactccagcctgggccacagagtgagactttgtctccaaaaaaaaaaaaaaaaaaaaaaaagcattgtagtcttagaattataggtttttgtagactcttatgaacctttccccactcacctccctgtgtagacatcatattttcaggatctctgtcagataaccatttaacctcttgcatgtcttcaatagtgggaaactaacaaaatagttaattttattgttaaaaagctttagttgtaataaaattgttttcgtatgttgactcaaaattggtctccctgaaattttggccaagtgattctagtttgatacatggcacaaattcctttataggatagcctttaagtatctgcagatagtttgaacattttaacttagcctgaaactccttaggctacacatttctgtttccttcaccagtttctcattgtcaggatttctagacccttttcatcgtagctgctttcttggtacactgtggtcagtctccccttgaaaagcggcatatataattgcatttattgagcaagtatttattgagggcctcttgtgtgctagggactgtcctggatgctggagatatcagtgaccaagacaggtcttctatagggaagaccagtaaacaaacaaatgaatagacaaagcaaaaataggtcataatgaattctgtggaagaaagaaacagggtgctgtgatagagaacaatgggggcaaggcagctgctttagatggggtggtcattcggagaatcagaagaggctggctgtgagaagagcctgggaagaagtgttccaggaaggaaaacagaaaactaaaggcacagtgttgagggaagaccttggtatatcctaagaattaatggaaggtctttgtggctgagaagcaaagtgattgatggcagagtgggaggagaaggaattggagagtaagacaccggccaggtcatgcggggtcatgtaggcccccatagggaatttttatataataccaactaatgagtgtaaaacaaagaaacaaaaagaaaccagtccacagaaaccagagttgaggcatgtgactcagtgttgactctcaaggtgattaccctgtgaaactatgtactgttcttgcataacaatttttggaatcttttgctttgaaatgccttcagaatcagttcatgcagaatacacattatatacattataaataccaaaataccttattatatattttgcttaaacattgaattatctgttaaatttaaataatataaaaaaatctcatttacccatgtagttaccatttctagtgctcttcattcctttgtgagtgtaggtccagatttccatctgataccatttccttccgcctgaagcacttcctgtaatgtttcttatggtgctggtctgccagtgatgaattctttcagctgttttatgtctgaaaacatctttatttaccttatttttttgaaaaatgtgtttgctgggtttagaattataggttggtagttttctttcagtacttgaaagatcttgctctgctctcttcccatttgcattgtttctgctgtcatttttgtttctctagatgtaatgtcttttttttggctgctttaaagagtttttattttgagcaattttactattatgtgcttaggtattgttttctgtatgttcttgtgcttgggtttggttgagctgcttggatctgagtttcagttttcattaagtttgggaaatcatttaaaaaaattttttgtctgcttctccccgttttcagatactgtaattgcatgtatattatagactgcttgaagttgtcccataactcactgatttattttatatttaaacatttttttctctttattttggatagtttatattactgcatcttcaagttcattaatctttccttctgcagtgtctaattaattagctgctgattttttccagtgcagttttcatttcagatgaagttttcatctctaaagtttgctttggctcttttttatgcccaggtctcttctccacctttgaacatttggaatagagttatattgactgttttaatgtccttctctgttaattataatatccatgtcaactctaggtctattattcccctgattatgggtcatgttttcttctttctttgcttgcctgataatctttaattggctgccagacattgtgaattttaccttgttagatgctggatatttttgtattcctgtaagtattcttgaactttgttctgggatacagtttagttacttggaaatagttggaccctttgaggtcctacttttctgatttgttaggtgggtctggagccattcttggcctggggctaattgttccctactactgagaattccactccaggggccctgaaccccctggctacggactggtactggtccccctaccccggcccctggtgccagaaagattggggactgctgttctactcaatgctgtgtgaattatgaggattctttttcaatcttccttgtgagaataggcactaatccctgtagtccttatggatggttctttcccttacttcaagtatttcctcacaagcatatgatgaatagttgaggaggaccctgcacaggtctctgggtttctcttggagtgtgtgcatccatctctgctgtattctgccctgtgacctctggccgcctcaagttccccagactcttagctctgtctcctcgactcagtgagtccagactcttagctctgtctcttcaactcagcgagtccagactcttacttagctctgtctcctcaactcagcgagtttgctgggctttttcttggttccccctgccccacccctgaactatgctcctggagactccctcaaggcagttacctggggcatgtgtaggacttttctcatttgtattccattcctcagagatcactgtctttcattgtctaacatcccgtgtcttgaaaaccattgttcttccctctggtgttgtggttgtttcagatggaagggcgaatttggccctcattattccatcttgacttaaagtagacatcacctccattttctcccctcaccccactttcttttgattaaaagctattttttaggccgggcttggtagctcacacttgtaatcccagcactttgggaggctgaggcaggtggatcacctgaggttaggagttcaagaccagcctgaccaacatggtgaaaccctgtctctactaaaaatacaaaaattagccgtgtgtggtggcgtgcgcctgtggtcccagctacttgggaggctgaggcagaggagaattgcttgaaccagggaggcagaggttgcagtgagctgagatcactgagatcggccactgcacgccagcctgggcgagagagtgagactctgtccctacaaaaaataaaaaaataaaaactatttttcatttaatctcaaaagcttgcaacagcataaaaaatactttattttcctttatggaagttgaaaattcaaatgtagttagatatgttaatatattattgcattgtagcttagaggttatgttctcattctgggttattctggcattaatcctgactcaatcactttccagttgtgtgattttgggcaaattgtttatattatctatccctttgtttcttcttctataaaatgagaataacaatagtgcctacctcatatggtagttatgaggattaaataaattaatatacacaaagttcatagaacagtccctggcatctacaaggcacttaataagtctaacttattgttatttaaatgagccctctggaaggcagggcattaagaagatttccagatttgctcttggagcatcttgagatgctgaaatgaggatggcagtttctaccgatggactttcctggtttgcagtttgaatgtcttggttgatgtcatcagatgttttggtgaattctctaagtggcccccacagaaacaggcacaaaggttccttacatgagccatgatggcgatttgtctaaagtttacatcaaatcatccagtaggggttggggaaaaggacagttttaagaatttggaaataatagtttggagggttgtaaccagatattggaggaaactagaggaattcaggatccagtgcagtttataggtggacagtgcctcaaagacaataaacaggactagaatctgataatgggcgtacttagagttttctatggaaacacaatttttctctctacagttcccatttctaccaaagataatcacaggctaatttgttcgcaaaataagttttgtctcattaagctggcctgattatatatgtaagtgcagcaagaatagtgaatatgtacacattctcaagtatgccattccagtcagaggtttgataatatctaaggggctttattggttttgtaaagtcaatctgaattccttaaaactgtctggtaataaggaatctgaaattagactttaaaaagccttttcagtctaagaagccaagcagaggacttgcccaattgtgtcctgttacaggggaaacaaactttcattgaacttatgtaaatatttatattgccatgaaaataaagaatactcaataagtttctgaattttggaggggttggggtagggagaaaagaaaatgtgtttcatttttgtttacaaaagtattcttcaccaaattgctgtaagttgtaggtcttaagggaaaagagaaaaggcattctttaactctagaaaacaaacattaaagaacccgcaatatttcaaagacataaaaattataatcaccctcatcagttcattcagtcccctgtaattcttgttctgcttgattttgggttagcagcctcatgaatccattggttttccattagagtgctggaaattcttacccagtccaatgctgtgatcttaaagttaccagaaacctgcacttgtcagagtcttttctgtaaatcttccagcaattttgtatcacagatgcttgcaaaagctttcaggaaaatatcagagtaaaaaatcactgtctgtagatggcaaaagatttaaaatgtccatagttacagatttgatgacagttcattttaatgcaattgacaaggaaatttggttgtttattttataacatttgaagataataactggaattatgactgataaaattataccagaacatatccaatttctaggaatttcatacaatttctaaaacacttacattaataatatagtcatacaaaaataacataaggttaagcatcacctttgacaatgcttctcatgcagtgtaatagatcaaataagcctagttagtttcacatatcaaataagcctagttagtttcacatttatttgacaatgcttcccatgcaaagatgcttaattagtttaatgtctgtgttttttttttttttttttaaagaaatagaacaagattttctaggggccgttgaaaaatcccagagttagtctaaggtcagaaaagacttcattcagaatttgatttttgagacgtttataaaaagaatacccaaaagattcaagattcaaagcacttgattaaataggattacaggtatttagttatccatttaaccaaagtgacaaagatttcaaaggcaaatacagagaaagccatgtagttgttaaaaaaaacaaaaacaaaaaaaaacaaaaccccttgactttttgagagagaaacttaatcaaagacagcacgaagcacatgaaattatcttgacaaaatacagaatctttgctttctaggcagaccattcaaaagttaaagaaaaacctttcacaatctcccatcaagagcaggcccatactccaagaaagtttagtcgttttaacaggagctgaaatgctagttatgcattattttgatatgaatgataatagattcattcaattttagccagcttaatcacacaagattctctctccctcttctgaacttcctatagccattttggtttttttccttcattttctttttcagcaaaaaacatatcttcctacttcacattttttcttgactgtcacgctagcattctgtagattgagaaatctatgtaaatacaccataatttctagaagcacgtttccttatattataatttttcagtgtagcacaggacatgtttactaacacacccaggtatctttagtttctctgtccaaaagtagataagcttatgttcagcaattaatgtttcagtatttatcttatgtggacttacattgatttaattcacttgttttgaacaattatgcttggattacttacgaaaatttcatgagacattaaatagctaagcatcatcttgtttttcttgctgagaaattttgtaacttagagatagcagaggcttatttgtaattcacttgtctaacatgagcttatttgactagtagacctacatagaatcaaagttgtacgtctgccttatgtctaatgctgacaactctgaaggcatattggttttttaaactaaaccaacaatgtttttgtttattgaaaattacccaagtcacatgaacttgaaaagcatttggattagttcctatttttctgagagttttcaggaatacttaatttatataagcacttgtttttacttatgtctattgaacatacatagctataagatctctgtgtctgtttgtgtatacagacagacacagagatcttatagctttcatttccaaattttagccatgtgtcaattaaaataatacaaagcttattggtttataaaagaagctggatccaaattgtacctgtgagagatggaacaagtcaaggttacctgctcagatggctacagctttttagtgaagattttttttttatttgagtgctgtagggatgcttttagagaagctatttttgagtcattttgtgttcagcagcttctgcatacaaatcaaagaatgcattccattgtctccaaaaggcttaggatactcctccttcaagggcactcccaaaggcagactatcttacctaaattaaaggttctccgaagtggtcactgaaattgcaaattattctttgtaaagttcacctattttttcttgtgaactttgtaaagttcacaagattctgatccacagtgtttttggaccccatctttgcattagattctctgaaaggtcttaactattaaggattcttttttcagcagctgctctggaacacagggaatcatgtgtttcacccttcccccttttgaacagaataggttgacttcctgagaagtttcagcaaaggttgttcagcataattggagagttctacacagaaggaggagagctcagattcaaaagagacttactctagaactccatggctgggtgagagagcagccagtgctgcggccctgggtaccagcacctagttactggccttggggcttcacaggggtcttcttctgatcctgcttctgacatcaaaaactgtcaaaagaaaattcagggtgcttttcttaatataaatattaagttagtaaaaaactgcaaatagggagacttccaaatcaaaagtggtaagaagcttgtctcacgaaggttatagtaaggtttataaagcctagaaaaggaaattcatacagcttaattctcactggttagaatgagtgggttagtttagtcattactgatttgctgcaatgtgctgagtcatgctgaccaagaaatgaagttcaagcttcatgtgcagtttaagtaggtgttttggagaataggtccttacaggttttcctgagctgggggtgggactttggctcagaggccaaggtttgtcttggcttctattttgatttttgcctaacaggaccattttgttgtctaagcttacgaatgttatcacatttcagttcaatctttctgattctcttctgatggactgctgctctgcttgtatatgtgtctttagtttggtgcctctcatcttttagttatgctgactctagaagtaagaactatgtgtacatagtataattttggaaaatatataaatgcaaagaagaaagcaaaaacaaaaaaacctcaatgagtcccactacttatgcatgctgttacaatctgagctcagtggtgagttacctcagcaagtagaataatagaggaaagaagatagactttggagacagacctggttttctaccccagatttgccacttactagctgtgcgatgttgagctggtattatttagtctgagctttgctttcctcatgtgcaaaatgagaataatacctgccaggtaaggtgttggtgaggatttttaaagtatttagtaagtgctcagcaaatgttcataatattttccttatttagatacttctgatttttttttagcatctaaaatatttgtatcatttgaaccttggttttattgtttattattttcaatatatttatttgaaacttttagtaaatttaatttgcatctttttttatttcagaattttctttctttgatcctaatgatgcatcatgccaggaaattctttttgatcccaaaacttcagtttcagaattatttgccattttgagacagtgggttcctcaggtccaacaaaacattgacattattggaaatgaggtaaggaattcttacattttaagttttgcattgttaggattgttaatggtatagatttttttccccatctgaaaggaagatggtaataaaggagaaaccctttaaaagttctgatatttatttgtatttccaggattttcatggggcagtgagttaatactatatattcttctgattatttcttcatgctctgtacttctgacatttgtagactcctggcgggtgcagggaggggcatttttcatatttccttctttgtaaaattaattttgtaaacttttatgcatttcataaagggatttgattaccatcatgttctatttacacttttggttggtttggtaaatatataggcttgaatgtagtctttaagaatattagattttttgagggagggttccttgaccagtatgttgctgtgttgtaggaagagagtgcttatacttttttcaaatatcattacacgcatagaaataaaattttgctcatttttgagaggaacatatttggagtgccagattacctttggaataatctttaagaatttccttcagcctgctgacaagttcagttttcattattgttgttgagtacagatttaaaaatttacccttaagatatgctcatactgtctatacattttactgagaagtaattcagatacgatagactaacttggttcctcagcattggtttgaaagcaataggtacctcagtagttaggttgtaaccatattttccttgactgcttcagattcttaagagaggttgcaatgtgaatgatagagatggattgacagatatgactcttttacattatacctgcaaatctggagctcatggtattggtaagtgtgtggtaaatctatcagttgcttatgtcatctgcacttgtgcttagataatctatatttatgcccatatattgtctgggggaaggcacccagctgatgatgataatattgcctgaagagctgaggattcagttaggtccttccaaaaaccatattccctttaatcaaggaggtctttataccctcctgatacctcttaacttttctggatcaggcctcatgcctgattgcataatagatgagagtaactagtaacaccctaaaatctttctgagggtttataacaaggtttgacagtccaaggtcagtctttgcatactgatccctaatcttaagaccccagtcttgagacctaaggtctgttcctacatatgtaacatatgtgcatattttccaaaattgttattctcttgtgctttttgtcattgtatgaacctgcatctcttacttaactatatattgtgattgtctctccttgtttcaatagtctgatgtggtggtgctgaagctactggtggtgatggactcctttttcccctcacaactcatcatgaactgatactttcacaaaataaaataaaaatgaatttataatacaaaataaaataaagccataaaatataagcccaaatatttttcaaatggcataaaactggccaggcatgatgatttacacctgtaatcccaacactttgggaggcccaggcaggaggattgcttgaggccaggagtttgagaccagcctgggcaacacagtgagaccttgtctctacaaaaaattaaaaaattagccaaccatggtggtgcatgcctagagtttcagctgcttgcgaggccgaggtgggaggatcgtgtaagcccagtagttgagggttggcgtgagctgtgattgtatcactacactgcaatctgggtgacagagcaagactgtctttaaaaaagaggaaagaataaaaggcataagactacatttcagttaacataatgagaagacatattaaatagggaaaagcaataaaaggtacacacagattgcaatttgggactgccagtggtccacggaacacgtttgggggagcactgatctgctgtgttgttgttgatggcttcatagcattctatgtgtgtctcaatttatttaaccaatttcttattatactttttggattttttagaattatattaacaataagagtgcagtgatgagcatctttgcagccaagtgtttatctgtatccctgagtatgattattttcttaggatcaattcttgcaagtgaaatttttgaagtgtgtctatacagtgcactgtttgctttggctttttaaatgaggcaattggtagccatccattggaacttaaaatttgtactaaaggaaagtaatttagaaaatcttctttaggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaaggcaagtattataagatcacctttagatattattaactgaacactttagtggtggcataaaaattataattcaaggatattttttccttctaatccatcttgtttcatatgcctttctactccattttatttctgagatagtttaaaatttctttattgagtattaattactatcttttctacaaaaggattagtacagagagatacaaaatgaaagagtgttctctgggttttcatatctctataagttctccagtataacacggatgttttatataattgattctacatggtttatgattcttttgccttgcttgggtagccagaaatagaataataaggtcttcagagattggaataataaataatatttattttagatggcatttggttctgaaattatataattcaacttaagggataatatttcagttttttttccctgttttgatggtgatatcctgaaattgaagatctgaatgtctaagtcacagtcctggtattttgatttttctctctggttctcttggggcccaattttcttttctttcttttttagaaaaatatgagagcaagcaaatagtattaacgttaagttaaagtgtacaatattttccccattgtaggaacatgcttcagagattcaatagataaatttcccagaatgttcatttctaacctccaatctgcataattgtccattttctctttaaaattctaccttttcaatttctaagtgatgttgggaagaaagcctctgtctacactactgtgtctttaataattcaagagagtttgtcgagtatttctgggtggtttgcagttgtaggaagggtatgtgggtgtggtgttgtttagttgagggtaggatttgcagaaccagaggtatatttaaacccttgttatcgaaaatactcaagatgggattcccaaatctggaggatttcctgtatttaagtataacatatgatgctatgttaaacgttattaacatgtccttagagttgcaagattacttttctcattatgaaattcaaattcatttgttcagtagagtattatgaatcaatttataggtaagcatttctatgcttaattagactttaactactttgaaaattctgctttgttttacctaccaggtattggccgttttttttctgtaaagggccagctactaaatactttagactttttggaccatatggtctctgatgaaactactcagttccatagttgtagcatggaagtagccacagaggatatgtaaatgaatgagtgtgcctgtgttctaataaaactttataaaaacaggtgggctggatttggcctctgagtcataggttgctgacccctgagctaaactctactactctacctcactgtagttgtcatggcaaatatgcaacagacttaatgggagattgtgataagctgttacttttacagatatgaatttttgccattaattgttttaaaatatgttttagtttgaaaatccaagataatatcactccatcttataatgaattttattgtactaataatcaactgcttattttaactagattgtaatataaagattttgttctgttgtgaaatcatgcctctagtgggttgatttaagtcttacaaatgctataagtccctcctcccaaagccctgtcttcttttaaattatgatagctaagtttaaacttttagttaatatacttatgatgtttaattgcagatgtggatgccacttgcagtgattttaattttggaacagctttgcatattgcagcatacaacttgtgtgcaggtgctgtgaagtgcctcttggagcagggagcaaatcctgcatttagggtaagaggttaaattaaaagtgaaaaatattaaaagaattaagaaatcttactttctggtaaaatgttgaatctgaatgttattaatagaagaactcttacatgagcaagtaatttatatctttgtgccacatgtaaagagtgatgatgatctttattgtaaataaatttaaggcataatgataaatttccttttatattgataagtcccattcaggaaagtaaagtcttcctttaagtgtcataatctttaagtatctttcatttaggagtttgatgtatttatgaaaagtcagctgttaagtagcaatacatatattacagttatatttttctgttaaatcatattctaaacttttttggaaattcatttcggaaagttatatacccatttaaggatgaagtaagcctttgaaaatgaaatgtttaaaggaaaagtgtattttttaatagtaaaatttcactaatttacagagttacacaggattgaatttcatagtcttcagatcatttgttgttgttgtttttttttttcagaaagtgttctgttttccctttctttatattaataacaataactcgctctggcaggtattcttaatcgtgttatactttcccttgaagggatgtgtgtgagcggcagatagtgtgcagtattcgaaaacacctgtcttcccttccctttcctatttttcccattttccctacttctttgccagttttctttctgtttaacccccttgattaccccccaacttttaatttcttctcttcctccctccctcccttctgactatattggttattgggcactgggagaatactacaataatgtagataaagcccttgccctcaaaaagaatgtcttgcagaggggaggtgggacagggaagcagtcagttttactgtagtgtgctaattcagtgtgacatgatggggcgggggtggcagagggccatggggtcatcttcccaaggcttcaacagggggtgacatctaaatcaagtgcttacataggcaagaattaaacaggtactgaagggagggtgaggaaagcatcttaggcagagagagtagcgtgcaagaagcctaggagatgatcattcagtccagctggagtgtgaaggggggaggcgtttgcttttgttggtacagctgttgacaaagccccattagtggggacaatgttctgaatttgttaggatgccatgagatacgttattgagctaaattaccaatttaggccagaagcagattaataggttgccatattttgaaaataactacttaaaaaaaaaaaaggtaaacgtatgggtcagcagtagccctcagaccatactttgatagccgccatcttattttttaatttttattttaaatattagattcagggagtatatgtacaggtttgtgaaataggttatattgcctggtgctgaggtttgggcttctgttgacgccgtcacccaaacagtgaacataccctagcccttccccacctccttccctcccacactccctcccgtctttaggggtcccagtgtctgttgttcccatctttatgtctgtgtgtacccagtgttcagctcccactaataagtgagaacatgcattatttggttttctgtttctgcattaattttcttaggataatggcctctagttgcatccatgttgttgcaaagggcacgatttcattatttaaatgactgtgtagtatgccctatatgtaccgcattttctttatccagtccactattgatgagcacctaggttgattccatggctttgctattatgaatcgtgctgtgaaaaacatatgagtgcagtgtctttttggtaaaataatttattttcctttgggtgtgtacagtaatgagattgctaggtcaaatggtaattctgtttttagttttttgagaaatctccacattgctttccacaggggctgaaccaatttacattcccactaacagtgtataaatgttccttttctccacaacctcaccaagatgttattttttgactttttaataatggccattctgactggtgtgagatagtctctcattgtggtgttgattagcatttctctgatgattagtgacgttgagcattttttatatttgttggttgcttgtatgtcttcttttgagaagtgtctgttcatgttctttgccgctttttaatgggattttttttcttgttgatttgtttacattccttatagattctggatattagtcctttgttggatgcatagtttgtatttttacccattctgtaggttgtctgtttactctgttgatagtttcttttgctgtgcagaagctctttagtttaatgaggtcctgtttgacaatttttgtttttgttgccttcgcttttgaggacttagtcccaaattctttgcctaagccaatgcctagaagagtatttcctaggttttcgtctaggatttttgtagttcgaggtcttacatttaaattttaaatccatcttgagttaatttttgtatatagtgagtagtgggggtccagtttcattgttctgcatatggctagccagttttcccagcaccatctatgagtagagtgtcctttccctactgtttatttttgtcagctttgtcaaagatcagttggttgtgtgtggctttatttcaggggtctctattctgtttcattggtctatatgtctattttttttagcaatatcatgctgttttgattactggagtcttgtagtataattttaagtcaggtaatgtgatgcctctggcttctgttctttctgcttaggattgctttggctatttgggctcttttttttttttggctccatatgaattttagaacagttttttctaatcctgtgaaaaacgatgttggaaatttgataggaagactgttgaaactgtcaattgctttgggcaatgtggacattttaatgatactgattcttccagtccatgagcatggagtgtttttccatttgtttgtgttctttcagcagcatttcatagttattgtagagatcttccatctccttggttagatgtattccttggtatttttattattattttgtggctgttgtaaatggaattgtgttcttgattttgttctcagcctgagtgttattggtgtatagaaatgctactgattttcgtatattgattttgtgtcctgaaactttactgaagttgtttatcaggtctaggaggttttttttggcagaacctttagaattttctacatatcgaaccatattgttggtgaagagaggtaatttgacctcctcttttcctatttgggtgccttttatttctttttcttgcctaattactctggctaggacttccagtactatgttgaataggcgtagtgacagtggacattcttgttttgttccaattctcaggaggaatgtttccaacttgcccgttcagtatgatgttggctgtgggtttgtcatagatggctcttagtattttgaggtatgttccttcaatgcctaatttgttgaaggttttttttttttatcatgaaggggtgttggaatttattgattgctttttctgtgtctattgagatgatcctacagtttttaattttgtttatgtggtgaatcacgtttattgacttgcatacgttgaacctccttgcatgacttgatcacggtgaattatctttttggtatgctgctgaatttggtttgctagtaacttgaggttttctgtgtctgtgtttatcagggatattggcctgtagttttcttttttgttgtgtctttgccagattttggtatcaagatgatactgctttcatagaatgaattagggagaaatccctcctccttggttttttcatatcattttggtaggattgttatcagctcctcctcgtatgtttggtagaatttggctgtgaatccattcggtccagggctttttctggatggtaggttttttattactgattcaattttgtaactaattattggtgtgttcagggtttcactttcttcctggttcttggaaggttgtgtgtttctaggaatttagattcctagattttctagatttcctctagattttctagtttatgtgaatagaggtattcacagtagttgctgaggatcttttacatttctgtgggattgttgtaatgtcatatttatcatttccaattgtgcttatttggatctttcttttttctttagctagcagtctgtcaatcttattgtttcaaagaaccatcttttcattttgctgatcctttgaatgccttttttggtttcagtttcatatagttgtactccaattttagttatttttttgactagctttgggtttagtttgttcttatttatttttttaacgtgtttttatttatttatttttattttttattttgtttcttttattatactttaagttttagggtacttgtgcacaatgtgcaggttagttacatatgtatacatgtgccatgatggtgtgctgcacccattaactcgtcgtttagcattaggtatatctcctaaagctatccctcccctctcctcccgccccacaacagtccccagagtgtgatgttccccttcctgtgtccatgtgttctcattgttcaattcccacctatgagtgagaatatgcggtgtttggttttttgtccttgcgatagtttactgagaatgatgatttccaatttcatccatgtccctacaaaggacatgaactcatcattttttatggctgcatagtattccatggtgtgtatgtgccacattttcttaatccagtctatcattgtcagacatttgggttggttccaagtctttgctattgtgaatagtgctgcaataaacatatgtgtgcatgtgtctttatagcagcatgatttatagtcctttgggtatatacccattaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgacattttaatgatcgccattctaacaggtgtgagatggtatctcattgtggttttgatttgcatttctctgatagccagtgatggtgagcattttttcatgtgttttttggctgcataaatgtcttcttttgaggagtgtctgttcttatttttctagttcccttaggtgcaatgttaggttgttgagacctccctgtcttcttgatacaggcgttttgtactttactcttaacactgcttttgctacatcccagaggttttggtatattgtgtctctattttcatttgtttcaaaggattttttttgaattctgccttaatttcattgtttacccaaaagtcattctggagcaagttttctagtttgcatgtatttgtgtggttttcaagagctcttcttggtattgatttctatttttactccacggtggtccaagagattcttggtgtgattttgatttttttgaatttgttgagacttgctttatgaccatggtcaatctttgagtatgttccatgtgcaaatgagaatagcatttatatt

SEQ ID NO: 3 - DNA, 184990 bp, Homo sapiens
ttttcccaaggtattttcactggctatagaattctggatgggctcaagtttgtttcccttaaagctgtcactcattatcttccacttgcatgccttctgacatacattttatctttgatgtattatatgtaatttttttcatggcatcctttaatgttttccctttatcttttaaacagctacaatacatttagaagcgtgtgtgtgtgtttcttttttggtatttactctgctttgggtttcactgagcttagtgaatctatggtttgctatctttcattattattgcaaaattatctactattttttttaaaacactttgtccttttggctgggcgcggtggctcacgcctgtaatcccagcactttgggaggccgaggcgggcggatcacgaggccaggagatcgagaccatactggctaacatggtgaaactccgtctctaccaaaaatacaaaaaaagaaattagccaggcgtggtggcgggcgcctgtagtcccagctactcgggaggctgaggcaggaggatggcgtgaatccgggaggcggagcttgcagtgagccgacatcgcgccactgcactccagcctgggcgacagagtgagactccgtctcaaaaaaaaaaaaaaaaaaaaaaaaaaaaaaaaaaaaaaacactttgtccttttatctgtctcttctgtttttgagactccaattatacatattttagattatttggtgttgtgccacagctctttaattcttcagtttttctcacttgttttttctctttgtattttagttcaggtaacttctatttacctattttcaaatgcacagatttttttttttcttcacctgtgtccatctgagctgtgtattgttgagctcatcaaacattcttcatctttaatagcatgttttccctttctcacattcctgtctgacttcatttttctgctgagactctccatctgtgtattctgttaccaccttcaccagttgccttccccttttaatcacagttctgtgaaaggccctcctgacagcttcagcacaagtgctgtctgacacttggcctcttgattgcctgccctcttggcagtgagtgattattccttgctttttaatgggtctcataagtttatttggatgttgtacatcatgttaagaatagcagagattgtcacaatgagatatcaacctcaccccaattaaaatggccattatcaaaaagaaaacaaatgctggggagggtatggagaaaggggaaccctagcacactgctggtggaaatgtaaattggcacagctactatggagaacagtgtggaggtccctcaaaaaactaaaatcagaactaccatatgatcttgcaatcccactatttggtatatatccaaaaggaaatcagtatattgaaggcctgttcattcccctgtgtttaagcactattcataatggccaagatgtggaatcaaccgtgtccatcagcaggtgaatggataaagaaaatgtggtccatacagtggaatattactcaaccagaaaattaatgaaatcctgttattttcagcaacgtgaatggaactggagttcattaatgttaagtgaaataagccagtcatagacaaatattacatgttctcaatcatacgtgggagctaaaaaggttgatttcatagaggtggtaagtagaataacataccagaggttagaaaggagggagggaggttggatgaagatggatggatgaagagaggttgattaaggggcacaaaaatacaattactaatagaaggaataagttctagtatttgatagtacagtagggaaattatagttagtaatttattgtgtatttcaaagtagctagtctttaagagaagaattgtaatattcccaacacaaagatacagcctgggcaacatggtgaaaccacatctctacaaaaaaatacaaaaattagctgggcatggtggtgcacatctgtggtcccagctgctggggaggctgaggtgggaggattgcttgagcccaggaggcggaggttgcagtgagccaagatcatgccactgcactctagcccaagcgacagaacaaggccctgcctcttcttccccacccaaagaaaaacaaaagataaatatttgaggtgatggctatcccagttactctgatttgttcattttacatcgtatacatgcataagatatcacatgtaccccccaaaatatgtacaactattatacatcagttttaaaaagaacaacagacattgaaataaagacatactcctgaaaatgggcatacctcctcttaggctgttgataggcaggaggtgttcagtctagtacgagtcgatttgggttagggttttgttcagtgtttgggcctgtgccttcaatgcctcacaagtttcaaattccttcagtgatgggctgctgttcatttgcttcgagttggggtttaggtgcagaaggaagggtttttctctgagttcctacctcccctgtagctttcagctcttaccacgtcattgcacctctgtgggagtcactgtctatgttcttgttcctcccacagaggtcatctgctgttgcgtgttattcacattagaggacagttggaaagtgaggggggcgtgcctgttgtccttaggtaggttctgtgttgctagaccttaagggtgcagcttcctcagggctcttgcacctcctcccacagaggtagctgactgccctgtggtcctcctgtaggatcctatgcccacaaggagagaggaaggtgtcatcttctcctcttcctcagcatcagaggatcttagcctggtcagagcacagggagcatttcctctacatccccaagaggcagagggactttgctgcttctcctccctccaaagtaatggatctttgcctgtgctctggggcagggggaagagggtgtgcaagaaagaaaacaacagtcatgttatacagcgagggccttgtgtagatagagtttatgtagtcataataatgcaagcactgaatgttgagctaaacaaataatataactgtaaggaggatgtgaggatggaagtatttctgttttgggaagccgcagggtgttaaatgatcagttaaattgtcatattccccagtgtaaggtcaatagttaaagcctaagactgaaaaacttaaaatgtcaatgtaaggatgctatttagaaataatgagggccagctgtggtggctcacacctgtaatcccagcaatttgggaggctgaggtgggtggatcacttgaggccagaagttcgagaccagcgtggccaactagcggaaccttaactctactaaaaatacaaaaattagcctggtatggtggtgtgtgcctgcagtcccagctacttggggttcccaagaattgatcaaaccaggaaggcgggggttgcagtgagctgagatcacaccactgtactctagcctgggcgacaagagtgagaccctatctcaaaaaaaaaaaagaaaaaaaagaaaaaagaattaggtaaatattaaataagcttcaaaaagtcacaattctttattctaagaagtggaaactggataggaggaggagaggagacaaagtatggctttttcattaccaagccatggagaactgtatgacattcaaaggtaggcgaataaagatgcttgataaaattaaatattaagttctataaatataaaatttgatacatttaaaactgaattctaaaagtttataacacaagggtagggataaaggtgtagggaaaataggcattctcatatgttggtggagggattccaactggttcaccctttaaggaggtcagtagggcactccatcaaagttccaaattcagtaattcctactacagatatggtagaaaattgtatttcacacttgaatgcaataagactagaaaccatccaaatattaccagtaggtggccgggcgcagtggcacacatctgtaatcccagcactttgggaggctgaagcaggtggatcatttgaggttaggagttcaagaccagcctggccaacatggtgaaaccccatctctactaaaaaaaaatacaaaaattagccaggtgtggtggtgggtgcctgtaatcccagctactcgggaggctgaggcagggaggattgcttaaacccgggaggcaaagcttgcagtgagctgagattgcgccattgcactccagcctggaggacagagtaagactccatctcaaaataaataaagaaaaataaaaataaagattaccaataggtgaatggttagcagctatacagtggaatactatctagccattaaagaaaaaggtgacactttgtgtacttacgtggaatgataccccaggtaagaagcaagatgcagaacggcatcagtgtctctccagattaccagagaaaccagaagtagttttgtttctaaggaaacagggaaataattctcttctaaggaagtgaacttgatagcttagggatagagctgggaggaggatttttttttgccatatacccttttgtgtcttttggattttaaactatttgagtcaattacccatataaagttttaaaaataaaattataatggttaagtacattgggctatttatatggaaaatactttaatttgtttcttagtttccattatatattatacattctgaatggaccatatgactaaatgagagaatcaatatgttaaaaccaggccaggcacagtgggtcacacctgtaatctcagcagtttgggaggccaaagcaggaggattgctttgaacccaggctggtctcatctcgaactcctgtggtcaaatcaacttcctatcccaggagtttgagaccagcctaggcaacatggtgaaacctcatctctatgaaaaatacaaaaattagccaggcgtagtggaacataccagtagtcccagccacttgggaggctgaggtgggaggatcacttaagcccaggaggttgaagcttcagtgagctgagatcgtgccactacactctagcctgggtgacagagtgagaccctgtctcaaaaaaaaaaaaaaaaaaaaaattaaaccttgagaacatatttcttgacattaggattggaaggttgtcttaagagacaaaagcatgtcaaaaagagtaaagatgaagtaatttgtctacactaaaatttaaaaactgacataaaaatgccataaagagaatgctgtgataatcatggactgagaagattgttgaaacacaattgtcaacatttggtatacagattatataatgaacgcctacaaatcaatgaggagaagagttcagggaacacttcaattgaataatgtgcaataaacacaaatagattgatcaggcatagtgtctcacgcctgtaatcccagcactttgggaggccaacatggcagatcgcttgagctcaggagttcgagaccatcctgggcaacatagcaaaaccccatctctactaaaaatacaaaaaaagattagctgggcatggtggcacgtacctgtagtcccagctactcaggaggctgaggtgggaggatcgcttgagcctgggtggcagaggttgcagtgaactgagatcgtaccactgcattccagcctgggcaacagagctagattctatctcaaaaaataagtatttgttaaaaatatgagtaggcagttcacagaaaaaaaaaagctgaactgtggaaaaaaattcaattttgctagtaaccagaggaaagcatattaaaagaaggcattgtttcatatctatcaagttggcaaaagtctgaaaatatgacttcgaggtttgggttggaatgtaaggaaatgtatattgtgattatttgaagtcgtatttttttatagctaggatgacacttcacatctgattttgatagtgtctttttacatgccaatacactatagacatctttctgttttaacatgatacatagaactctgaactccatttctagatgtatttaacaggatatattatccaatgataagactaatttggataggattctttctgagggaaggataatggtatagagaacctcaaggtttttcttagggttttatagtttttcatttttaatgtagattgttttctgcttttttaaaagacattattgcaagagcatctcaagcagacgtcgttacaatcgtgatttggaacaggatgaagcatttattccagttggagaatcactaaaagaccttattgaccagtcacaaagttctggtagtgggtctggactacctttattggtaagttaaacgttcctatagacatgaatggtgtgttgatttagaatgtgtcctcatgatggtggacagtataattattgcagatcagggaacaataatggacacatttttttctccttatttagaaagaggtatgcagtattgcaaggtgaaattagttaaaaataagaaatatgaaccaagaaaaatagaatagtcaagtaagatagagctataaaccaggttataggaaccaagtcctacagagaaaggcaggggaagttagatcacgaagtcctatatgaaaggcaagagttagctcacaagttttgctctaagcattttaccagccaacttaaagaggaatcaggtataagattccttgcatctgtaagtttaaactgattgattgagggaactgtaactatttcagattctgaaataaaaaagaagtttcaacagatattcttagagaggatgcttctctcaatatactactaccaaaacacatagttcaataaaaaataattttaaagggaattacaaataaattccaacaaatttggatggattcttggtatcagggaaaaaaaaataatcccagcaggttcatttatatatggaaatactcagttttgggttgaaggaactcttatttgagaggacctgtattatgaacactagatatccagataggtttaagtttttaattgtattagttgaaagaaactgatctcttcttattttattttattttactttattttattttaatcgtatcgagatagtcttgctctgtcacccaggctggagtgcagtggcccagtcttcggctcactgcaacccctgcttcccaagttcaagcaattcccgtctcagcctccgaagtagctggaattaccagatgcaccaccacaccaggctaatttttttttttttttttttttgagggatgaggtttctccatgttggccaggctggtctcaaactcctggcctcaactgatccttccaccttggctcctaaagtgctgggattacaggtgtgaaccaccgcacccaccctgatctctaattttgaaattcatcttattaaataactctaattgaattggaaaggtaaaagtaaaactgccttcataggcagacaacatgattgtttacgtagaaaatcccaagaatggtacaataaaactactgcagccagtaaatgactttatcaggttgcagaatacagagtcattgtacaaataccattgaatttataggctctagcaacaaacaattaggtaattataaaaacagtatttaaaatagcatcaaaaaccatgaaatatttagaataagcctaacaatttatgcaagacctgcacactgaaaattataaaacattgctgaaagaaattaataaagccctaaataagtggagatgtttataaatctgaggactcagtattaagatttcagttttcctcaaattggtgtgtaatttcattcgaatccaaatgaaaatcagagcaaacttttatagcaattgatgtatattctaacatttatatggaaatgcaaaggactagaagagccaaaacaattttgaagtagaagaacaaagaggaatcactacctgatttctggacttaccgtaaaactcaataatgatctcaatttggtactggcataaggatagatgtattgatgaatggaacagattatggagtttagaaaggaacatgcacttaatatggttaattgattaaaaaaaaaaaaacaaaaagatgcccaagtaattcaattggaaaaaggcagtccatttaacagatggtgcaggaaatatcaggaatccatttaccaagaagttaatctcagtccttacctcctcactctataccaaattaacttgaaatgtagcatagacctaaatgtaaaagttgaagtataaaacctctaaaagaaaatgtctgaaaaaattattctgaccttgggcagacttcttcagtacataaaaaacacaaatcatttttttaatgataaatcaggctttatcaaaatttaaaacttctgctatttagaagacaagaaaatgagaagacaagtcacagattggcaaaacagatctgatacagggtttttgtgcaaaatatataaagaccttttgcaactcaataataagataacccaatttttttaaaaaatggacaaaagatttgaacagacacttccccaaagaagatataagaatggcaaacaagcacatgaaaagatgctcagcatcagcagggatatacaaattaaacacagtaagatactactgcacatccactagtatagctaagactgataatattaagtggtgccaaagatgtagatcaactagaaatctcatacattgctggttggaatgcaaaatggtatggctattttgaaaaatagtttgacaattgcctggaaagttaagggcatactttccgtacaatgaagcaatccttctgctaattatttacccaagagatatgaaaacttgtccacaccagaggcctgaatgtgaatgtttatagcagttttatttataatagacataaactggaaacaaccccaaagctcatgaattgctaaatgaataaacaaatgctggtacattcatacagtggaatattactcatcagtaaaaaggaacaacttctaacacatgtagcagcaacagtgggtgaatttcaaaagtactttatgctacatgaaagaagccagacacaaaaggctacacaaaagtgattctcctgcctcagcctcccaagtagctgggattaaggcatgcaccaccatgcccagctaatttttgtatttttttttaagtagagacagggtttcaccatgttggccaggctggtcttgaactcctgacctcaggtgatccacccgcctcggcctcccaaagtgttgggattacaggcgtgagccaccacgcctggccaaaaagtgagaatttttttacgttattaaaatattctgtatcttaattgtggtattggtgattacatgatatagatttgtccaaggcttgttgaacttttctcaaaaagggtacattttatataaattatacctcaataatcttgacttaaaaacttacaggctgaggcaggcagatcacttgaggtcaggtgttcgagaccagtctggccaacatggtgaaaccctgtctctactaaaaatacaaaaattagctggacgtggtggcagatgcctgtaatcccagctgctcgggaggctgaggcaggaaattgttttaactggggaggcagaagttgcagtgagctgagattggccgccgcactccagcctgagcaacggagcgagactctgtctcaaaaaaacagaacaaaatttacaaaaggattctataataaatgatacataaagtcactttagctttgcactaaatctagtccattttagaagcatttccaacttggagcataatgttctttttaatttagaatgatcactaatgcttctgaaaatgaaagataacaatccatgtacatcttttatttaacaaatattaaagtacttctgatattgtcccaaataaatacttatattctgtgagcaggggatggaattcaagcaaatatatatgtaaataagaataaagttatgattgtgttaagcgcagcaactgagaggttttgtgtgctatgaaggtgtttaagtgagaaaatagcactctaagtaaagggaactggatattcaaaaaaacccagcgacaggaataagcttgagtgaattctaaaagttgagataagtcaaacgaggtttgtgggtgggtggtcaaagcaaataatgggaccaggccagatcaggcagggtcttatagatgggatttttaagatctttaactgttatttggactttgctgcataataaaccaccccaaaacttagtgatgtgaagcaacaaacattatttctcattctgtgagtctgtggggcagttcatttgttggacttgcttagctagagctaggtggtgtagttcacacccttggccgacagttcatgctgccattattttttggtcacagggttcccaaagcagcaggaagggggcaagccccagtccacaaacatttgtcaggtctttgcttgcatcacgttcgctgttgttcttttatccaaagcaagtcatgtggcctaagccctgagtctgtggaccaagactacccacgactgtgtgcactgggagggtaattattatgaccatttttgcaaacagccagccacttgaataacctgtttatgatttcagaatacattgtacattgtttcatactttaaagtacattatggccgggcatggtggctcacgcctgtaatcccagcattatgggaggccgggggtggggtggatcacctgaggtcaggagttcaagaccagcctggtcaacgtggctaaaccccatctctactaaaaatacaaaaaaattagctgggcatggtggcgggtgtctgtaatcccagctacttgggaggctgaggcaggagaatcacttgaatctaaaaggtgaaggttgcagtgagccgagatcgcgccactgcactccatcctgggtgacagagcgagactccatctcaaaaaaaaaaaagtacattataagtttttaactggagttggttgggtacaccatgctttttgatgagatggactacccctttgccagtcttaatgggtttctttcatcaagagctcaaaccttttacttttttctataaaggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtgggtacacactgattcagtcaatttcatttttgacaaggctagtgaggtacaggtggaagcctccatatgtgctttgaaaatgtgtgagttcaactatatacatttggctaaaggaaacctagtagaatacacggtttgaataaaacatagtccggaatgccaaccaagatctttctttactaaccagctgaagaaacagcagtgagtttcaaatggaaaataatactagtttattggacttactcccatagtaatgaaaacccagtcttttatagataacttaagcagtgatttagggtaacattaacatatgtgccttttccctttcataagctcaacagcccaacatgcagtttcattgtacgttctgtgtttaatgtgtgtttccccccatctccacatttacacaatagcaaagtaatttaggtgtgagctggtcagtcaggtacataagccgatctggctatcctgagttttcttttcccttcacctcttgttttcctccctttaatttggagagcccatagcatgttgccaagcaggcaattgtattagtttcctagggctgctgtatcaattaccacaaactgggtggcttcaacctccaaaacgtattcactcagttttcgaggctagaagtttaaaaccaaggtgttggcagagctgttgtgtctctgaatactctagaggaggagccttccttgcctcctctggctactggttggtggccaggaatttttggtgttccttggcttagtatagacaacactctagtctccatttctgtcatcaggtggccttctccctgggtgcctgggtccacatttccaccttacaacatcaccagccattgaattcgggcccacgctaatcctgtatgagtcatcttaacttgattacatctgcaaagaccctctttccaaataaggtcacgtttatagatgacatggattttagacatgaattttgtcggggagcactgttcagctcagtacatagcactcactgacctttttctggagggaagagggtaggagagaaaggaaaagagcaggactgtgggcctggcagtcaacgagccagactgaaaaggcagctgtgatgagtcactgatgggcaaatgggagttggcttaattaggagctaactcttagttgaacattcttaattttataaaagtgtccactttttgctttgaaattgagagccttttctactagagaatcatgtaggttgataatattctccaggttatttgtataatatgtcatctttttcttttctttccttttcttttcttttttttttttttgagacggagtctcattctgtcgctcaggctggagtgcagtggcgccatcttggctcactgcaacctctgccgccaggttcaagtgattctcttgcctcagcctccagagtagccgggaccacaggcacttgccaccatgcccaactaatttttgtatttttagtagagacggggtttcgccctgttggccaggctggtctcgagctcctgacctcaagtgatcctcctgccttggcctcccaaagtgatacaggtgtgagccaccacacccagcatatatgatctttttcttaatcctattcactttcatgattattaagattattataaatttattgtagaagtacagatatatgtgtaaatgtagaaatataatttttagtaacacattcacgacttggtgtcaggcgaattaaagtttcactatctgcacatgatacctaagtttttctcagtatccagaatgagcattacttctccctagcctatctctgatgataactaaccttttaaactcatcaactggacaggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacaggtgagtggttctttgccccactgttttgaaattattttaatttccaaaagatatttccctatttgtattcaagataatggaattctaaaaatgtgcatatgcttgtttttagttacataaatgtatagttgggggggattttgttctttttacaaaaattgtgtcctacttctcctatacataattcttgatatatatatatttttttggtgtttttttttgtttgttttttgttttttgttttttgttttttttaaagacagtgtctcactcagttgcccaggctggaatatagtagtgtgatcttagctcactgcaacctcgacctcatgggctcaagcaatcctcccacctcagcctcctgagtagctgggactacaggcatgcactgccacacctagctaatgtttttattttttgcggagatggggtctcactgtgttgcctaggctggtctcaaactcctaggctcagctgatcctcccaaagtgctgggattacaggtgtgtgccatatagtcttagccatccttccatttcagctgatgtaaatctacttcattctttttaacagatgcagagttttccatatgtggaggtactgtagtttattcttaagacccaactgatgaacattaaaggtgtcttcagttgattatgaaaaggttttttaatgaacattgttgtattttaaccatatattatatatttgatccttgtgcacttgtacaagcatttcttcatgatggattcctagagaagggcctgctgaggcagtgagtttatacatattaaactatggtatgttgcatattatttctttcagcagtgtgcctcagtttacacacccgtaagcagtagagataaggatgtcatttttctgtcaccacttgatagtgtcagtattttaaaacaaatgcaagtgttagaaattacaaatttttaggaaacctttgaaaccattttaatcttgtaattctagaatggagtggctgctttacatttcagaattcattttaggctgtaatataaaagtaccagtctttaaaacaactgtaagagacatttaaatctgttacagtgttctgagtcagtgtagtatttgttggctcagatatttatcagatgctataggaaaatacaacgcattatattgatcactgctttagagtaattattactaattgtcagtatgatcatgtaaacattgctaacaacagaactctgttgatgggacccataaagaagaaaatgtaatcctatgtcacaaagccttagtgtatcatatgagagtggtaaaagcaagcgattcctcttgtattttcatattcaccacttctcagacataattatctactactttatcttttttttttccttttcttttctttttttttttttttttgagagagattctcactctgttgcccaggctggagtgcagtggcatggtctcggctcactgcagtctccgcctcccaggttcaagtaattttcgtgcttcagcctcccaagtagctggaattatagtcatgtgccaccaaccctggttaacttttgtattttatagagacagtgttttaccatgttggccaggctgatcttgaacacctgacctcaggtgatgcgcccgccttggcctcccaaagtgctgagattacaggcatgagcaaccgtgcctggcttaactttatcttatattcagtgttgtcctctttcttagacaccagacttatttagtgacaaaacctgacctgaacggatgtgaggtgtgtattgcccttatccagttgaggaggactatcggacttagtgttttgctgtagacacagtactgagtactgagttggattaagagtgctgccccaaccctgctgaggatgtcatgtagtatgtagcatgtatttaaagaaaaatctgaaaaatgctaaattccacaatgcatctggccccaaggagaaaaagaagcttttataaaataggacaaaaatacaagataaactattttatttttggccctcaacttggaccttggctttcttttgtttcagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggaggtgggagtttgagtagtttctgattatgttgatttactcatcattttaaaaataacagctccagttatataactttttagtttttaatttttgtgggcacatagtaggtgtatatattattggataaggagttattttgatacaggcatgccatgtgtaataatcacatcttggagaattggatatctgtcccttcagacatttatcctttgtttcaccaaccagttatactccttgagttatttttaagtgtacaattaaattattactaactgtagtcctccccgttgtgctataaaataccaaatacttattcattcttctattttgtctctacttattaaacatccccccccatctgctgctacccttcccaacctctggtaaccatccttctgttctccatgagttcagttgttttgatttttagatctcacaagtaagtgagaacatgtgaagtttgtctttctgtgcctggcttattttacttaacgttatgacatccagttcctccatgttatttcagaaggcagaatctcattcttttttctggctgaatgatactccattgtgtgtaggtgccacattttcttgatgtgttcatctgttgatggtcacttaggttgcttccacatcttggctattgtgaacagtgctgcagcaaacatgagggtgcaggtatctcttcggttagctgatttcctttcttttgggtatacacctaggagtgcaattgctggcagttacgtaatttagatgtcacatacgtcagagtccccaagaccacccccaggttgtgcgatttcacttgaaggaccacaggactcggcatgtggttgtcccaatggctaacatttatcccagtgaaaggatacaaatcaaaatcagccaagtttagaaaaccaggcgaggcttcccagaatcctgtcccagcggagtcagggcgtgtgcttcattcctcttactagttgtgacaacacatacaaagtgttctcattcgggaaagctccttagagacttggcacccagagattttactggaggctggtcacataggcatcctctgcctggcatgtaccagaattccagcaggaaagcagacgtgcagtacacaccacattgtttgcacaagcagcccaggagtggtgagttaccctcaccgtttccggtaagttttatatccatgtagggaactgtttaccatttgtgtacccgggcactggccaaggccaaaccttgcaagccgcctttcctaagggaaggtctcaggcctgctgtgtgaacccttatctgcacctcataagtctttctactgcagagcaaaatgaaacaaaataataaaaactattcattagtaggaacaaccatataagtaaataattatactttagggtaaatggctgatttcgccttgcttattttttttaaggaagattgatatgccctttgtcgatggactctatcacagttgtgatgacatccctggtggaggtagaggaaatagttggacataaataagagaaaaacatacatctactattaagagtgaatcatagtgtctatattttttcttgtgtaagaatccgttttagttccatagtttagcaaaagatgcttactagattggtatatcttgtccagcaaccatttttgtgcccatgttttctcattcccttatagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaagtgagtggaactcagtcccctgaagaagtgattcgtaaatgccaccaaatatattctctgctcactgaacatctctttacttttcagtgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagactttcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagatgccttgttatctcaagaaatctgatttacataaacttatacttctttaatgctttttaaatatttattctgagcaaacaattcatgagtacatcaagtgagatagttttatttgattataacataaaataaatgtgattatatcacatcatcatcaaaaaggtttaaattaaatgggaggaaatcagcatatgtccacccattaccaaaatttgactatcatttaaggttaaaacttacaaatttgtctgcacatcaaatttcacaaatttgaaaattgccttaaccattttgattaataagtttcatctgccataattaaagtctgaagtgttcatcaagataagtaaatttgcatatggataatacccaataacttgttttttcagaatttttcaccatatgtatactgagaaatacaaatattttaatctgcgttgccgtatgatatgattgcacttagaacacccaatttacttaaatcttggtttacttttgacttgataccataatctttaaaatcatttgtcatctttttttttttttttttgagacggagtctcgctctgtcgcccaggctggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacctgcctcggcctcccaaagttcatttgtcatcttaataaaaatataaagacaggcaaagtttattggaaatgttcaaatggtgtgtggaagcaaaaaattacagccagtatatgagaccactattatggttttttaaaattaacttggtctagtaaaagtgatatcaagagttaatcttagaaacttgctcagtaaaaacattttctagtataacatgttctttaaaaagcaaatgctgccgtctttggaatcttaatctaaaaatgtggccgggcgcggtggctcacgcctgtaatcccaacactttgggaggctgaggcgggtggatcacaaggtcaggagttcaagaccagcctggccaacatggtgaaaccccatctctactaaaaataaaaaactcagccaggcgtggtggcgggtgcctgtaatcccagctactcgggaggctgaagcaggagaattgcttaaaatcagaaggtggaggttgcagtgagctgagatcgtgtcactgcactccagcctgggcaaaagagcgaaactccatctcaaataaacaaacaaataaataacaaaaaacaaaaatgttgcattaaacttagttcttgtctctcctttccactcttattcttaaatctgaagctcatcgactaagtgaaatatttaaagaatatgataggccagcaagaagaagtattatgtagtaccatagttagtaaattcgtaaaaccttggaagccattatttggtcccacttgcaatttagtgtttttgaagtgtgtagcttcattcagatagctctttaaataattaaaatataaaagcaaacaacccaaactacctgactataaacaggaaaagttaaccctcaaagagagttcttgtgaattctctttatgctggcaaatagctctaggattaaaggcacattagggtttccttcagtttgtttattctaagcttttactgtgctttttactgaacaagtttctgatgtataaaacttgcatctgatttctttggaaatattttcacaaaagttattttaatcagtatttttacattgcctttccagtgtccagaagtgtttctaaacttagaaagtgacctatagttttttaaaattatgttttcctagaacgtgccaaattttgatttactctaacaatcagtacttttcttcagatgctttgttctgtttagaacaaaaatgcactatagtttttaaagaatcatgcatctttgggttggcccaggatcaaatttgatattgaataatttattccagggcagctttcataaacatacttcatagatgttgttttgaaatgtttctaaatatctaaaatcatttcaacagcagaaatgatttttattttaacaaaagattatgatagcccttgtagtgtttaaaagtggtcatatttattactgactttgagtcaggtgttaaaatagcagtgccacagctcgtctcttgccttagtgtgctgctgtgagagtcacagtggaaactgcagggaggaggtgtgttcctaagaaccaaaatccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctggcccatttaaaaactaaaatgtagtatatattgtataaaatggaaatatcattattgcttcattaggggaaactgtacataggcattgaaagaagggtaaaagcaagcagttttatcaggcagttgtaaaacaccaaaaatatagattcgtctttgacgtgtaacacactaaatgtattttgtacagcatctggtttaaaaggtgccttaagagtttaccattacttgctttgttctatatacagattatgtccaatgtatcattttgaagtaaataaccttattttagtatactttagtgatgtgttttgtgatgctacactcagacggtattgtgcatcagaagtcatctgttgagatttttgtaatgattaagttagtgtatatacatatgttcctgagatgtacacttcaactaccagaaacccagtatggagcacaggtaggtacacgcttgccctgtggagatagagaacttctaaacctatcacggtgcaggggtttttcctttaaaaaacaagacaaaacattgttttctttttcctttttttttttttttttttgagacggagttttgctcttgttgcccaggctggagtgcaatggcacgatctcagctcactgcaacctttgcctcctgggttcaagcaattctcctgcctcagcctcccgaatagctggaactacaggtgtttgccaccatgcctggctaattttttgtatttttaatagagacagggtttcaccatgttggccaggctggtctcgaactcctgacctcaggtggcccacttgccttggcctcccaaagtgctgagcttacaggcatgagccaccatgcctggccaaaacattgttttctgattatggaaatgtactcatggcagaaaatttgggaaacaacagcaaataataaagcaaataaaaatcactcaaaattctattgccagacattatcactatatacatttgagtgtttcttttcaatctttttttttgagagagtcttgctctgtcactcagggtggagtgcagtagcgcgatctcggctcagtgcaacctctgccccctgggttcaagtgattctcctgcctcagcctcccaagtagccgggattacaggtgtgcaccaccacgcccggctaatttttgtattttagtagagatgcggtttcaccatgttggcccaggctggtctcgaactcctgacctcaagtgatctgcctacctcagcctcccaaagtgctgggattacaggagtgagccactgcacccggccttattcttttttatgttgcattttttgtaatattaggatcctagtatgccattaaatagccattgagaactttttttttaatgactgcacaatatttgactaagaagatggagtaatttctgtgctcaatcccctattgaatatttggattattttcattgttttgaaaaatagatattaagcatccttatacataaatctttattttcttatattacatttctgaaaatgagactagtggatatgaacttttaaaagatcctttaagatggaaaaactaaggttcttggaaaacattgccatattgctactcacaaagcttttcattttcattcctgctagcagttcatgagcttagagcgatgggatgcatttacctggccttaagatgctcctgctgcaatgggaagtgaagccttggatagctttcctcctcctgtgcaatactttcttgtcattttcccacctgcactgagtcccaccgccagtcagggctgttttcaggtgtatgtgaattcatcccagcagtgtgccttctgctgccttttcctagggaactgaacatgttaaatcacagacgcgatgtggcactgattattgttcctcaaaagaaatgcgtgtctgaagatagcctcttacagattcctcacgggagtctctgttcagtgtcattgtaagtttctcagaataatcgcaggcgctctgatgcagcctggtaaagaagactcagtgatttctgggaactgcaaatgcttgccagctttccttctgtctgtggaaacactgaataaatgtattcatttctcctttccagcaatctgttagtctcactgctccattccaaggtttctttaatattattaacagagcagacattaagaaacagaattgtctaatccttgttcttccaaaataggtttaatccttgtagatagtttcaagcagacagtaagtcagttactaagttttcacttggagaaacatttgctgatagtagtagcatattgaccatttctgacatgtcatccttatatcaagttaggtgcacgctcctacacagccttggctcagcgcttggagcatacagtcttgactgggtggacataaaccgctgaaagtggccagcagtgagcagaggccacctactatcagcggcactgctgcaggcatggagacttaaatgtgtgagtgctggtataagcagaagtgggagagtcacctcgatgctgggatccagatggcggcttatttcaagtgcagtggcacatacaaaaaatatttttggaagggagcaaggactagggctgaaaggttcattcataatctttttttctttttttttttaggtggagtctcgctctgtcacccaggctggagcgcaatggggtgatcccagctcactgcaacctccacctcccgggttaaagcaattctcctgcctcagccacctgagaagttgggattacaggcgtgcaccaccacactcagctaattttgtatttttagtagagacggggtttaccatgtgggccaggctggtctcgaactcccaacctcaggtgatctgcccaccttggccttccagagtgctgggattataggcgtgagccactgcgcccagcccataatctccttttgacataggaattgttaattcacatattccatcaacctattgctcctctgaatcttagcagcttcttggtctttgttcaaatgaaatctaagtcaattccatatctctcaatgtcgctacatccacctcagtgcttatatcctaattttgtcttttttagagacagtcttgcactgtcacccaggctagtgtgcagtggctgttcacaggcataatcataacgcactgtagcctcaaactcctgatctcaagccatcctcccacctcagcctcctgagtagctgggaccatgccaccatgcctggctcacattctaaacattatgcaggaagctcaaagtgaaaatcaatatggaatgtttatattgaaaatatttttggctgggtgcagtggctaatgcctctaatcccagcactctgggaggctgaggcgggcagaccacctgaggtcaggagcagcctggccaacatatagtgaaaccctgtctctaaggtacaaaaattagctgggtgtggtggtactcgcctgtagtcccagctccttgggaagctgaggcaggagaatcacttgaacccaggaggcggaggttgcagtgagctgagatcgcaccactgcattccaggctgggcaacagagcaagactccgtctctcaaaaaaaaaaaaagaaaaaaaaatatatatatatatatacacacacacacacacacatatatatatatatattcaagcaatgtgaagaaaatattgggcccccttgtttttctttaatggaagagccatttttaaaagccagtttagaatccagatgatgacatctgttgctctactgtatgactgaaatgcaggtcagtgttgaaaaacataaaaaattggaagtctccactgaaagacctacactgctgtgggagggattttaatcaagacatttcaaaagcaatttttattacttgatcctgtcctcatacttggctaggagttcagctggagatagaatctaactctgaagatgatactccatgatcttctagcatcccttgtcaccagtgagaagtctgatgtggatctaataagtgacatgttatacaggttaacttattttcaagaaatagaattttctttttattattgatgttggaagttgaaactggccatatctaaatatattcattctgtttcttagtactaatgggatcttttcttagacctgggaaattttctcccattatttcttttgtttcttcccttttttctttcttttccttttctctttctagaactttctagaacaaatctcaggtcccctagatgtttcttccataattgttactatgcttctcatatgtttcatcctaccttctacttttgtcagcccatctgagtttatttcaacagccaaatgttttattttgaaatgattccaggcttccattaaagtttcatcaatagtataaggactgccatttacccttcacccagattcataaactgctaacattgcacaattgctttgtcattctgtgtgtgtgtgtacaggaatcacagagactcatcttgtaatgtttgtaatgtccatgtatcgtgtatgcacacatttttttctgacctattagaagcaaattacagagctaatacccctttatccctaaatacttcagggatgttctattacttaaccaattatgtacaattatcagaaccaggaaagttcacattgatacaatagcaatgaccaacaataccataatctatagaccttactgaagttttgctaattgttattttggtgtggttgggttttttgtttgtttgagatagggtctcactctgtcacccaggctggagtacagtggcacagtcatagctcacttcaacctcaaactttgggcctcaagcgatcctcccgcctcagcctcccaaagggctatgattacaggcatgagccaccatgctggcctcatttcccctttccttctcaaaaggattctggctttccctactgcattcatccacgtccactacccgctccaagagagctgagtaattgtcaagccaggtttggggagctttcttgatggaggggatggaaggagggtggtgctcaggctacagcagggagagcttttctgtttttgagctaaagacataacagggtgcagaggctgagaaaaggagagttctaagcaacatgtcacgagctatgtagcctcttcacactgcttctgaaataaaatctaacagtaggagtgactttgacattatgttgtggtttctgcagacaacttgggattggcccctgtgggtttgttaagggcatgtttgtcagagtatgggggctccctgcttccagaggcccagcagctgctgtgtacctggggttcagggctgacggcagggctggagttctggcacacagtgaccccaagtgtgtttatttttttccttgtggtgatggttgaactgttttagggttggtttttgttattgttttttttcaacttttattttagattcaggggctacatgtacagatctgttacctaggtatgttgtgtgatgctaaggtttgtggtatgattgatgccatcacccacatactgaacatagtacccaacagttagtttttcaacccttgcctccccaacatgtctcaagggctgggtttgagtttggggctccgcccaaatcactcccatctccccagcagtctcacatgtttggggtcatgatttcctgttgctgtttcatttcagacctgatcccttctatttttcaggaattactaaaatgtcctgatgtacttatggtaccgtctcttgttttccaattggagatttttttttttttttttgagatggagtttcattcactcttgttgcgcaggctggagtgcaacggctcgatctcagctcattgcaacttctgcatcccaggttcaagtgattctcctgcctcagcctcccgagtagtggggattacaagcacccgccaccacgcctggctaatttttatatttttagtagagatggggtttcatcacattggccaggctggtcttgaactcgtgacctcaggtgatccacccgcctcggcctcccaaagtgctgagattacaggcatgagccaccaatttggggattttaaaatattttttccacatcaggtttgcaggtaccaccgtgtgctccgtccattgtggtgttttgggtgccacagtgagggtgctgaccgctggtctgggtaacggggggtctgcttgcaggacaggaggagcctccacccaggtggagacaggaagtctatcagatgaacttcagaagtcttgctaatctggggggggggtcctaattttaggaccgtttaaacagaaaatttgcccttaaacttgatgttaaggttttgtgaaatgcagtcatatatgttttgttgcatggaaaacaccctgtccagaagaaccatttctctagttctcatcccagaaacttctggagtgacacatccatgctgttggcagagcttgcccgttagcactttcatgtataatcttcctctcaaagaggaccaactgtatgagggttggatgacatgtaccccttccagaagggatcaattcacttcatttactatgggcagtaacttccaaaggataagactgcattacctaatgtctcaactgttaacagcagagcctgaccagtcactgcatgattgagcagaaagaagacacagcacagtctgcagcagcaaggctcacctgctactgggcttctaatctttgttctggcgtggccgtctgcttcatgccttggggcagaattggtcttggtaactgagagctgcaccgggggtgggtgatacttaaacctgtggttaagataataaaatgccagaggccaggcgtggtggcccacacctgtaatcccagcactttgggaggctgaggtgggaggatcatttgaggtcaggaattcaagaccagcctggccaacatggtgaaaccctgtctctactaaaaatacaaaaattaggcgggcatagtggtgggtgcctctaatcccagttactcgagaggctgaggcaggagaattgcttgagcctgggaggcagaggttgcagtgagctgagattgcgccactgcactccagcgtgggtgacagagcaagactccgtctcaaaaaagaatgccagaatacctaattagagctgtaagatcaaccacctcacactaaagacaaagttcaagagaggttgtgatttaccccaggtcaaacatgagcagtgtggcctggcatactgttccttttaacaccgatgttttagcacattgagtgcacaaaacttagtgctaaataaattctgaggaacaagtgaagtaataactcctagcaaacaatgagaagtgctgataaccttgttaacgccaacaagcaactcactacgaagtccagtctgatttttttttttttttttttttgagacagagtctcgctctgtctcccaggctggggtgcagtgtcaccatctcagctcactgcaacctccgcctcccgggttcaaccgattctcctgcctcagcaatctgattttcttatagagaagactatattcaacaaattttgagtacttaataccaaaaaaaaccttgtttctgatagctagatgactgttttctcaggccagtttgctataggatctgaacttttttgaaaaccatatgctggtatattacaggaataattgcagctatgagctgtactgtctagtccagtattagtatctttgcctagtgtggaaacttccaagtgttttatatagaataaacggaaatcattctacataacagggcctggaataatcagtcacatttacccacatagtttcacgttgtcccatgttttttttacctactctaccaattatttttgccctccagaagtaaatgaggcagagatttgaagggcatcactttattccaaagttgatcattagtgagggggatttttacagtcttctttccctcctccctcagctgcctcctggttagagatgctaacaagaattacgatggtcctaagatactggaggaagtaaaaaagttgaaggccctacatattttagttcacgtttggcatttcttggtctttaccctatgtaaggcaaggagaaaaagacatgaaatttaaattacagataaacacaagtgtattagtccattttcacactgctatcaagaattgcccaagactggataatttataaaggaaagaggtttaattgactcactgttccacatggctggggaggcctcaggaaacttacaatcatggcagacagtgaagaggaaccaaggcatcttcacaaggtggcaggaaggagaatgaacacaggaggaactatcaaacttataaaatcatcagatctcgtgagaactatcacaagaacagcatgggggaaccgcccccaagatccaattacctccacctgatctctcccttgatgtggggattatagggattacaattcaagatgatattttaggtgggggcacagctaaaccatatcctacaaggaatgactgaaactaaagatactaatttcctttcccttggttggccaggctgtcgtcttcattactgactaatagagaccaagcaggttggtttaatcccattgccctctagtgctttccaatgttggccaaaatgttgcctccattttaaacattcctcctggggaagaatgtctttctatcatacgataagggagaagagaagaggaagcaagagaaaagtttaaagtgttgtacagaagtttccaaccacaggaggagcaaaacaccaaagaagttgtagaatacagggtgtggtgaagagttggagcccaggccgtgctgtctgagaaggcatgccaagccaaggttcaggcttcctaggaccatgtcctgcccggagaagcattccagtccttctcatcatggagaaatggccaagccccatgtggttacagggaagccacgtacaccacaccatctttgcagaaggtttccagggaagagacagaccaactgaatgacctccagcccatccttggccagagccccaggccgaggagagctgggcgagtccatgatgtctgatcagattggggctggggttcaggtcttaaacatcaggaagcccccaaatgcagtgcccgacaggcttctctttgttattgatccctgggttaactcaaaccatactcgctcacccttctgcagctcagccatggcaaagaccgttgctgtgcttccactcccctgcccagtggtacagactggagtccgatggtgacctccaaacaccagctgcccggtgcctggccctgggccaaattcaacgctcactgcaaacaggtagacaccacgctcaggggctcggaagtagccatgttcagggaagtagctgctgccaatgttgatgtatgtggtgttgaacttcactgtctgcagggcagccgtcccttctgaaaagctggcatagaaggccacaggggatcctgaaacataacaggacagtgcttagtgattcatcccttacaccattgggtgggaaattaaaccctgagacctaccgtcctcaccttattagcaatggaaataggtcactatttctagataacctagatattcccaacagcagtgttattgcaggagaaaagctagatggccaattctgtttttcactaatagagaggaaggaaaatgcaagtctgttgtctgagctggtgtacattttaacaaaatactttcattttttttttagacagggactcactctgtctcccaggctggagtgcagcagtggtcatgactcactgcagcccttttttttttttaacgtagagatggagtcttactatgttgcccaggctgatctggagctcctgggctcaagtgatcctccagcctcagcttcccaaaatgttgggcttgcaggtgagccaccatgcccagccacaaagcactttctcgtttgatcccttttccttccaacttccttgagagacagtatccctgattgacaaaacaggttgaatccttcaccggctgcccaaggctacatggtttgtaaatggcaggctgggacaggaacacgggtctctgactcccagacgaccaccacttgctaggaatcttgagatactcaggggagagggagaaaatatccatcctcaaggtaataataatgctaacactgggaaggtatctgcagagccatgaaggctggatcctcctggatgttgaagacagaaccttggagaaagaaggaaagagcaggtggagccagggaagagaagccccttcaagctggtcttcttttttttagttgataaagggtctcttgttgcccagactggagtgcattggcgatcatggctcactgcagcctcaacttcctgggctcaagcaatcctcccacctcagccacctgagtagctgggtctacaggcatacgccatcatgcctggctaattttttattttttgtagagacagagtcttgctctgttgcccaggctggtctcaaactcctgagctcaagcggtcctcccacctcaaccccgcaaagtgctgggattacaggtgtgagccactgttactggccaagctggtcatcttacatatgggtaaattgaggcccagaaagaaaaagcttattgctccagaccacacaactagtaaattaccaagcctcctgggaacagaccttgaatctctagacttctggttctctgcagggaccactttggccagccttaggacaggaacactgacagaacactggtgccaggcccatgcacgggcacagaagcagaggaagctgccatgtgtggagggtgtacaaacagccaggaagaagccagtcctgctgcctggacagcatggttgggcagctggggacagggtcatgagatggcacaggaaaggtaagtcctacttgggtcctggctgtgacactggccttggcaccaacgaggtcatgtccaccatggggttcctcaacttgctccctctgtaggggtttaaaacaaggtccccatttcttaggtgataaaaccaaagccttcagaggagcagtttgctgagcaattactgacttgggtcccggaactcaagcctcagctctttgactcccaatccagcaagcctttgtgaataaaaaaatgttgcttttctctagttctggaagattttctgagaattagacagctgagaatagctttctcatttgtgttcagattgtgtcaaatcagccgggcgcagtggctcacgcctgtaatcccagcactttgggaggccaaggcgggcggatcacctgaagtcgggaattcgagaccagcgtgaccaacatggagaaatcccatctctactaaaaatacaaaattagccaggcgtggtggggcatacctgtaatcccagctacttgggaggctgaggcatgagaatcgcttgcacccgggaggcggaggttgccgtgagccgagatcacgccgttgcactccagcctgggcaacgagagtgaaactccgtcaaaaaaaaaaaaaaaaaaaaatgccgggcgcaatggctcacgcctgtaatcccagcactttggaaggccgaggtgggcggatcacgaggtcaggagatagagaccagcctggccaacatggtgaaatcccgtctctactaaaactacaaaaattagctgggcatggtggcaggcgcctgtaatcctagctactcgggaggctgaggcaggagaatcgtttgaacccggaaggcggaggttgcagtgagccgagatcgtgccattgcactccaccctgagcgaaagggcgagactccgtctcaaaaaaaaaaaaaaaaaaaaaaaaaaaaaaaagattgtgcccaagtcagaggccggcggctgcctctgcaattcccctaacaccctgcaggtggttctcttgcctagccgaaggaaggccggcccgcagcgccctctaccggtgctaggccctcgttccggccgttccgtccgggcgcctgcgcagggagttccgccgcagagagagacccccaccccaacccagccttgcgcctgacaggccctaagatgcgggaagggctgtgcaaactcagagtgtgcttccctgcagggcacacattcaagccctacagccttcctacaaacaaataaagggaaatttggggtgtgtgtgtgtgtgtgtgtgtgtgtgtgtgtttgtgtgtgtgtgtgtgtgtgtgtgtgtttgagacagagtcctactctgccgcccaggctggagtgcaatggagctatcttggctcacagcaacctctgcctcccaggttcaagcgattctcctgcctcagccttccaggtagttgggattacaggtgcctgccaccacaccgggctaattttttttttttttttgacagtttcgctcttcttgcccaggctggagtgcagtggcgcaatctcggctcactgcagcctctgcctcccgggttcaagtgattctcctgtctcagcctcccgagtagctgggattaggcgcccgccaccacacccggctaattttgtatttttagtagagatggggtttcaccatgttggccaggctggtcttgaactcctgacctcaagtgatccacccgcctcggcctcccaaactgctgggattataggcatgagccactgcgcccggcctggaaatttgtttttaagaacaacatttttttgaaataaatatcgtcgtggtaaacacatttccaaaccgtggggcaaattctgaaagtcatcagcatattgaagccttgcaccacgcacgagaggaaacaagagagaagtgtcagtgtcggtggacacaacctgaaccctgaaaatgctggggaaatgggaaaacgttgactgcgttcctacatgaggtaagcctcgtgctaggtatttggtaaacgcagcagtcttcataacaaaactttgacatgggtagggattctgccattttactgaggaagaaacagacaagtgatgccagagcctgggtgcttcccactgctccacattgcctcttgggccatagggagggtcagctggggcaggggctgcctgggacgggaccttcaacaaggccttggacttgccacacgccaggctgcacatggccaagatggtggccttgtacttagccctgtgtctgggtggggagaggccacagctccaaggccagcctctggcagagagagtcacttgagacacagagcctagttgtccccctcccgggaccacactcagggaggggatgggaagcttggttgcacatgccttcagcctcaaagccagctcccaggcccagggccctgcagggaccagccatggagggccttctggaggtgaagaaccggcaccctaaagacagcgctcctctgctgctcactagctgtgcaagcaggaaacttgtgtttgcgcctcagtttcaggtaagatggaagtgctgatgagtgtgtcattgacctgttgggatgggccattgtggtaaagcccaggaaggggactagcacagagcgatgagacaggttaactgtatttgcagagggaatgagctcctttcagggcccacggctttccctgtacagtccactgaggtgtgttccaagaccttagcaggtgcctgaaatctcagacagtaccaaaccctatatatactatttattttcctctatgtacatacctatgccaaagtttaacttgtaaattaggcacagtaagagattgacaataataataaaatataaagcaattataacagtatactgtaataaaagttatatgaatgtggtgtctccctctctcaaaatcttattgtactgtactcacctattttctgatcgtggttgatgcaagaaactgaaatcaaggctgggcacatggctcacacctgtaatcctaacactttaggaggctgaggtgggcagattacttgatcccaggaatttgagaccagcctgggcaccatagcaagaccctgtctctacaaaaagtacaaaaattagctaggcatggtgacacatgcctgtaagtcctagctactctggaggctgaagtgggaggatcagctgagcctggagaggtctaggctgcagtgagccatgatcccaccactgtactcaagcctggacgacaaagtgagacccatcttaaaaaaaaaaaaaaaaagaaaagaaaaagaaaaaaaaaacaaaaaaaaaactaaaatcatggaaaatgaaacagaactaagtggggctgcaagtggccacagtccctatccacattcttcctagatacagtggcttaaacgcacatgggaatgaagggggtgaggtgaagagatgagatggggggacttgaaggctgccctggcagggcaggaggcgatgccctctctgtagcaggagcagtaggcggcactattgtgcctgtggcctccaggctatgccgctcacgggctctggcactagcaggtggttcttgtgacttctgtctccccataagccaggtagcttgagagacccacacccctgagaagcaggtgggccaaggggaaggtggacctagtaggggtgacggatggccatcctgttctctttcttcctggccctcttggaggcagaagagctgccggcagccggccctggcctcctaggctcgtccagtctccccagcccaggaactcacctgcctcccagagcgccgcgcccaaggcacctggcacaggccctgtgacccgtatgtccaccaaaggctccgcttccttcttgtccctcttccggggagcttccaggtctttctgctgcttcttccctttcctgctcagcatggtctgcagcttccccaggtccaggctgacgttggcttccatgagcccttggaagttcccaaagaggctgtggaagagccgctggtgctgctccaagctgcgctgagtggcgaagagtgcgttgtggaggccgtgaagggaggcgttgagggaggcggccccggccccggcctcggcctcgcagcaccgcccgacattcttgacgtcgttgctcaggctctggagctcccgcgccagcccggccagggcggtggtggcggcctcctcgcggcccgcgtcgtggctgggctccaggtgctctgccggccgcgggggctccgaggcctgctccagggccgtcactcgggcggccagctcgtcccagccgagcgcctgctcctgcagcccgctagcggcgtcctgcagggccacgcggatctgctcgtagctcaggggcagcggtcccggcgtctgctcagacatctcctccagcacctcctccccgaagagcgcggccagcaccgcctcgtgccgcagcgcgtcctccagcagggcggcgaaggcgctgtgcagctggcgcacctcgtggcgggcctcggccgcggccgccttcagcgcgcccacctcgtcatccagcgcctgcacttggctccggagccgcgacgtggccgcccgcgcccgctcgccctccgctttgtgcgcgtccacggccagcgacacggcgtccacggcgttctgcagggcctgcagggaggagccgtccagctgccgccgctcgtccaggctcacctgggtctcctccagggcacgcgtggcgtccctctggccctcccggatgacgtccaggtctaaatagagcttctggcaattgcagtccttcacgtacttgatgaggtcggcatggccaccctgcaggtgctgcagcgtgaggttgagctccaggagctgccgctccacctcctccttgttctcctccatgatcagagacttctccatcaggatcacgcgcagctcacggagcgccgtgtggttcacctgcagctcctccacctgccgctccaccttgctaatctgatcgaaagtctcgtccgattcggagtacagttccttgatctcatccacgtgccgggtcagggtggccctcatgtcctccagggtgtactgcaactcctcctccctgcgggccgtggtcatgtgcagctctgagaggttcctctgcagctggcccagcctggcctgcaggctgtccggctcaggccttgccccagccccaggcgttgccaacaccagactgccattggtccctggggcctcctgagccttgtgcagcctcttcaatttggtgtccacatcggcttggagctctgagatcgagcggtgcagggtaaagtgctgggcgtgcaggcggtcctccacgtcctgtcgcagctgacccactctctgagtgttctcctggaccttggcctcaaatttggcaccaagctcctggaagtcagccctggccacggcactgtcctggactctggagatggcctggcggttggcctccacgtcaagagacaggtttcttatggcctgggtaaggctgtgcaggctttggttaaagctcctccagatggggctgaaatgcacttgtaggaaggtgtccacgtggggtagcagcacctgctccaaggatctatcagggaactctgcaacagacatgtggtgtgacacaagccctgcaggagcagacactcctcccaggctgggaccagcggggtcctcccctcctcccctcaatgtgaccaggctcttcctcagcccctagagcctgccactcaccgtgccctgtttgatttgcttccatcactgcagctgtgaggttaccaggcagggctttccacaggcctggcaggctgtctgccacccggtgcacatcattctggagatctcccagcagatgttcctgctgttcctgttgcacctcaacctcattgatcactgcagcaaggtggcctaaatacacagcagacataaatgtcaagggctaactcaccaggcctgggaagatcacaaggttcagagaaggagagttgaaggctgagagcagggaagttagctgctgatgtcctctgagcaggagcttagaagccttaaacccctggagggcaaatgcatagcaagtgagccctcaccctgcctcctacacctacagcagacatgactaatcaatcatggtacactcccctcctcagcacatgcacatggcctcacaacttcattcttggcagcccttgtcaataaatacttcaccacataatgaaactcatttactttctcaatcttgggcccagccttaaagggccctgctgcaaatggtgtctcttggtgggtttcctgtgctgactccaagaccaaggacagcatgacttcctggctctggttagggctgtgggaaagggtgagaatgctttttccaggcacaagggcttgtgtggttcagcggggcaaggaaagtgccagatgaaccagtccttcccagaagatggggtgaaggaaaagggtgtgtgtgcttggccagtaggccgctgggggccctgtgagcctggccttcaaggtgggaggtggtacaggccacagagcaggccttgctgattctggaggcaaggtttccctgaaatggcactgctgtatcacaggaaaaagggccagctggctacatgggccccaccagcctgcctgccttccccttccggaaagcaacacaccaggtttgaagctgactggtccatcctgaggttcctggtggctgtcaccaggatctgcaggctcagggattgccatggaatctgcagaagaaagcattagttattgaccccagtggtcagaggagctgcttgaccttggggatcagaggtcaaggggggaagggggccgcagggagccctaccgtggtgctcgcagttggggcccgtgtagccagggcagcacctccaggccaaagaggtcagcaccttctgcttgacctggtacactggcttgtgggccatgcggtacctggaagaggagaagggctggctcagtgattccagggagggcccgctccaggcctgggcaaatggcccaccctcccctactcacatgactttgactttctggcagtctggagctccctgcggacacggctgctgcgagtggatgaggaatttctctgttttgcaaagagctagtaaggtgaccagcttggacattgggtaggggcaccagttactggaaaacaagccagaggagaaggctgctgagccacacccaggtcaacagggggtgccagtgcagagccaccggtcctcgcctcctgccggagcagtgctgggattctggaatccattatcctgagaagagagccttccgcattattcatccctgggctccagagcaaatgtttcacaatccctacctgcaaagagggcacctgctccaccaccttcccgaagcctccccgagccagcagagaggctgagaaacccaccacaatctagaactgtgaaaagcagctccagggtgatgattgttttagccaacaaaactaacagccagagtgtggggaaaacaccgtgtgcactgcagctgtctgcatggattccctttggtgaggttagccacagagccagaaagctctcgctgtttctcctgctaccaacgtgcagctggggctggagaatcctgggttcgaatccctcacactttctggctgtgtgaccctgagtgaggcacttagggagcttctctttccccatctatacaatggcgatcgtaatgccctcctttaagtgggcagagaagcaccaggtgcctggctcctgacaagcgttctgtgaacacagctccactgccccattccagctgccctggcagcctgcccagttgctacttacatgagggaccagctccctggccatgcccattaggaccattctagaaagggactttcaaacagttgtcctaaggaaaggtaagcagctgggtggagcagtgtcctctctgggatggccaccgcatcaaggtcatgcaaggtggttgggggtcacactcagcatcccgcacacctgataggtagcccttccatcctggcccttcaccagcatgtactgtggtggtcccaggagcggggggacactcatgctgacagagccccagttcacagacccagtggctgactccatggggtcagtggcagtggtcagagagcccttccccaggcagccagctcccagaacagagctcgtcagagttgaaagtggcaatgatctctgtggcacagtacagctcagcacctcttgggtgccgggtgctgcactcaagctcagggtgtggatgtggaggtgcagactttcccttcaggatccccagggagagcgggcactcttagaatgggtgagaagtgctaggatctgcagagactttcaggagaaggagctaatggggctgtgtcttaaggccagaaagtcggatgaggcaccagatgtgacaggggtgcaagagggtgaggaaggggctgcagaaggaggctgggatgaagggagaagccagacctcagcggaggagctggcccatgtcctgagggcatgggaaatcatggaggggtttcagcagggaagtggcatgaaagagccaccctggtccctgggtgcagagatgatgggagggcaagacgttggcagctgtgtccacggtctggggagagatgatggcaacttggactgagtgatggtggacatgggagaagtggccacatttgtgggctcttagaaagcagcattcagaggccttggtgatgaagtggctgtcagtgccgggattttattctctggagccggtctttgtcctggggccatcaagcactgtcacacaggggatagtgttgggaaaggcaggggcgggggattcgagtgacttttttttttttgagacggagtctcgcactgtcgcttgggctggagtgcagtggtgcaatctcggcttgctgcaacctccacctcccaggttcaagcgattctccttgcctcagcctcccaagtgggctgggattacaggtgcccaccaccaagcctggctaattttttttgtatttttagtagagacggggtttcactatgttggccaggctggtcttaaactcctgacctcgtgatccacctgcctcagcctcccaaagtgctgggattacaggcgtgagccactgtacccagccgagtgaccatattttgagtgctgagtccccagcctgctttaccctctcagcagcagactggaaaagtttctcaggaaaataagccagcccgagaggaaaagacccaaagctgctgacagcaggggttctcccataaaaatagccaaccagaagatcctatgacaaaatgggtaagaaaggagtattcatacaccccagcttccagtcagtttctcagtctttctcctcttaagtgagcagacatccaagatttacccaagaaacactgtattccaaaagagggccaggtacagtggcgcacgcctgtaaccccagcactttgggaggctgaggtgggaggatccttggagcccaggagtttgagtccagcctgtgcaacgtagtgagacctcatccctacaaaaaattagccaggtgtggtggcgcatgcctgtagtcccagctattcaggaggctgaggtaggaggattgcttgagcccagaagtttgaggctgcagtgagccatgattatgccactacacttcagcctgggtgcacagcaaaaccctatctcaaaaaaaaaaaaaaaaaaagaggttgaagtgggcaaacaaaaaaatgtcaacctggacaaaaactaagactgtgtaaggagaagagaaccactcaaacatttgtactaagatttccaggttgataaaagaaattactgcacccaagaaacaagaccaggaagctatgaaaaaaacaaatgagggggagatgggagaggaagcgtgagcattcagaaaacaaaaaggaactcttggaaattaaaaacgtaacagtaaaaatgaaaataaatttaatggaaacgttagagggtaaagttaaagaaatttccctaaaagagcaaacagagagatgaaaattggaaagagaaaagaaaaatagacgaccagtcttgcaaatgtaacatccaagtagtacaaatttcagaaagagagaacagatggagaaaatcatcaatgaaaaaaaatcaggccgggcatggtggctcatgcctgtaatcccagtattttgggaggttgaggcaggaggatcacttgagctcaggagttcgagaccagcctgagcaacatggcaagatctcaatctccacaaaaaaattaaaaaattagccaggtgtggtgatgtacacctgtagtcccagctcctcagatggctgaggtggaagggtcccgtgagcccaggaggttgaggcttcagtgagctatgattgcgccactggactccagcctgagcaaaagagcgagaccttgtctcaacaacaaacaaaaaacatattccagaagttaaggacttcaatttccagattaaaagcaccaccagttacctgcaatatgatgaaaatacacttacatcaaaacatgtcatatgaaattttagaactctgggaacaaagatggtttctacgtgcttccagagaggaaaaccaagacaaacacactcatacaaaatcagtaattggaatggctttgaacctctcaacagcaatattggaaactggaacacagtgaaaattgcattcaaaatactgaagaaaaataatttacaacccagaatctcatatccagcctaactatgaaccagtgtggggagtgagaataaagacattttcaaacaacccaggtttcagaacatttacctcccatgtatcccagtaggagactacctgatgagcagtggtttgaaatattgcctgcacatcaacaccatcatgcaagccaggtgtggtggcttgcacctgtaatcccagatactcaagtgactgaggtgggagaactgcttgaggcctggagtttgagatcagcctggagacatagtgagaccccatctcaaaaaaaaaaaaagacacccaaaaacaaaaccattgtgtgacactttaaaaataatagtcttggggctgggtgtggtggctcatgcctgtaattccagcactttgggaggccaaggcaggtggatcacttgaggtcaggggttccagaccagcctggcaaacatggcaaaaccttgtctccactaaaaatacaaatattagccgggcatggtggtgcacgcctgtaatcccagctactcgggagactgaggcaggagaatcacttgaacccggaaggcagaggttgcagtgagtggagactgtaccactgcactccagcctgggtgacagagcgagactccgtctcaataataataataataatgataataataataataataatagtcttgggccaggtgcagtggctcatgacgatcatcccaacactgggaggccgaggcaggaagactgcttgagactaggaatttgagaccagcctgggcaatatagtgagacttcatctctacaaaaaatacaaaaaataataaaaagaggccgggtacggtggctcatgcctgtaatcccagcactttgggaggccgaagcaggcggatcacgacgtcaggagtttgtgaccagcctggccaacatagtgacaccctgtctctactaaaaatacaaaaaattatctgggcataatctcctaattatcctagctacttgggaggctgaggcagaagaatcgcttgacccgggaggcagaggttgtggtgggccaagatcacaccattgcactccagcctgggtgacagtgagagactccgtctcaaaaataataataataataaaaagaaagaaaaataatagtctcctagatcccctgagcttagggcctgagcaccagcattttaaggctctctgggtaattgcatggcacacccaggatgcagaaccgtggtgtcacaggaaacactctaacaaaacaacagagaaaatcaagaaagagaaagcacaagatcaggaaacaggttccaacacaaaaaccaggtgaagagagcctccagaatgacaatgggctgtggtatgagggcagcagttcacattggaacacacctggaggctctgggagccacatctccaagaagatgcagctgatctgacacctggcatgaatgagtgtagagagcagatgtggacaactggctgagggtgtggagttgagttagtgataaagacacagaataagcagaagaaaaaagcaagacatgaaattttagaactctgtgagttctaaatttttactacagggaaaaccaaaagtgtgcaagggggcaaaaaagtttcacagtttatttcaaggcttaatgctgagcagtacacatggccctatggatgcgtgcacatgcatttgctttggggtaggaatgagatctagctcatagataatgctacttccatcccagctactcgggaggctgaggcaggataattgcttgaatctgggaggtggaggttgcagtgagccaagatcacgccattgcactccagcctgggcaacaagagtgaaactccatctcaaagaaaaaaaaagataatgctacctcctaagaagtagcaatgcaagcatgttctttagtgatacagaggtaaatgcaaaagaatcacctgcaaagttgaaagtcattgcccttgggaccagagggagctggggcttctgactgtctcaacaagccttatagaaccagttgactcctaatcaggagatcagcaaactttttttctaagggtacaggtagtaaatatttgacacaaggccagctacataatcttcagggcccagtgcaaaatgaatatgtggggcctctccttcaaaaagtatgaagaatttcaagatggtgacacccagggtggggccctccagagtgcagggccttgtgtgtgactgcacaggtcacatgcccctgatgctggccatggtttcaggctttccaggccacatgaactctgtcccatctactcaactctgccattgtaccacaaaagaagtcaatgacaacatataaatgaaccagcctgtctgtgctccaataaaactttgttagcaaaaacaggtgatgggctggatttggcccactggccatagttttctgacccctgcctatgagtatatataactaataaaaatgaaacttaaaaaaaaaatcattttcatcaggaagagaaaatgcagatgaataatcaagaacagtttggaacctggacacagtgactcatgcctgtaatcccagcactttgggaggcccaggcaggaggatcacttgaatgcaggagtttcagacaagactgggcaacatggcacaaccctgtctctacaaaaaatacaaaaattagctgggtgtggtggtgcacacctctagtcccagctacttgggaggctgaggtggaaggattgcttgagctgaggaggtggaggttgcagtgagccgacattgaaccactgcactcgagcctgggtctgccctgtctcaaaagaaaaaaagaaagaacattttgaaagaaaacaatgagtagggagtttctctcacaactatcaagaccgactccaaagccaaggaatgaaaatgatggggcgttggctcaggattcgatatgccagccagtgggaacagagaccaggaaggggccagtgcatctccaagggatcagtcaacgtaaaaaggggacacctcacgataaggatggaaggaaggaaggaatgctcactcaacactgaaacagagagctgggaaggcgctggccccagagctcaggagccacaggtgtcatgcttgcctgcacagacatccacctggggccccatggaaactcctggaacatgggctcagtattgggggaacccactcccaatatttcaacatacattctttctattttccctaagtgtcgactggtctgagaaataaagagaaagagttcaaagagaggaattttacagctgggcctccaggtgtgacatcacctatcggtaggactgtgatgcccacctgagccgcaaaaccagcaggtttttattaaggacttcaaaaggggagggggtgtatgaacagggagtaggtcacatgctttaaggggcaaaaagcagagcaaagatcatatgcttctgaggaaacggggcaaggacaaaatcaaaaactccgataagggtctacgttcagtggttccatgtattgtcttgataaacatcttaacagaaaacagggtttgagagcagagaaccagtttgatctcaaatttaccagggctggggtttctcaatcctggtaagcctgagggtactgcaggagaccagggcatatctcagtccttatcacaaccgcataggacagacactcccagagcggccgtttatagacctccccgcaggaatgtaattcttttcctagggtcttaatattatattccttgctaggaaaagaatttagcgatatctctcctacttgcatatccgtttataggctctctgcaagaagaaaaatatggctccttttgcccgaccccgcaggcagttagaccttatggttgtcttcccttgttccctaaaatcgctgttattctgttcattttcaaggtgcactgatatcatattattaaaacacacgttttacaatcaatttgtacagttaacgcaaaatcacagggtcctgaggtgatgtacatcctcagcttatgaagataacaggattaagagattaaagcaagacaggcataagaaattatgagtattattagggaagtgataaatgtccatattaaaatgaaatcttcacaatttatgttcagagattgcagtaaagacaggtgtaagaaattataagagtattaattttgggaactgatatatgcccatattaaaatgaaatcttcacaatttatgttcctctgccgcggctccagcctgtccctccgttcagggtccctgacttcccgcaacagctcagccctagggaaaaatctctcttagaccagtggttctcaatgggaggagagggtactttccccaggtgcattgtcacgactgggtggtgggtgctactcatgactaggtatctcatgggtggggcccaaagatgctgccaaataccctacaatgcataggacatctccacaccccaccacaaggaattatctagtccaaaatgtcagtatgccagggctgagaaactctctctaaacaaacttccattccttgcaaacctctgacctactgcagagggcctggaaggcgtgtgccccaggcacgcctggcctggtccagcctgccaggagtgactgggactttccacctcaagctcctggaagtggaaactatgccgcccacccttcctgcccaggaactttctccgctgacctgcccagaccctgggcttcagcactgctattctctctgcccatgctccccaccctgggcaggccctcccttggcacagtacaggctgctggcccagaaccctgggaacattcctgacctttgctttggcttcctccagctcttggcagcttctggctggcccttgatgcccatgcccccggcccaacttgctgaagtgcccatttttccctctgcccctccgtctcaggctggcttcatctttgtgccctcccttggggagtcctgctgggtgccctcatctcccagtggccaacccagagtggatgtggggctcctctggcctggtttggagctgcccttggtctgctgtggccccaacctgctgctccacccagataggagggtacgtggactcctttggagctttaaatggaagctgggcggcctgcgttctcctctcctcctcctccctgaacccacagtgaccttgggcaaggcccttcccccatcatcgaaatgcgaagaagctgtgcctctgcggcacacagatcagagctggtgtggggggaagggagagggagcctgtgggagggggagggcgcatccattatgcagattgtgtggagtgccttcccttccccagccaggaaacgccctcccaggggccctcaagtcttccttgggaaggaaggcgtgttctcagcagccttgttttctgaggccctgaagccagccattaacttgaccattccaggggagaaactcacaggattttgtccttgagtcagaaaagggccttggcagagaagcctgaggctctcagggatcagcccagagctaagaacccctgagcgtggttctggaagcttcagctctggccagtgggggttcttccctgttcataccaagggctctgtgcccggcaggggtcgggggtgggggtgaggatgggggaggaacaagtgcaaaaggtgcatcgtggcccagagaaggcggcctgtgctctgccctgctcctgtgtgacctccagtcatatgctggactcctctgggccacaagctcccagctgggaaaatctcagtgctctttgtgtaagggtcaggagaagcctgaggctggtgactggggccaaccagcctgctggcagcagcatcccctacacggccaccctcttggggggacaggacagcctgggtgggcctgggctctcactgtcacttaggagctctgtggccctgggaggcgtccccacccctccaagctatcatagcaatgtgatagatgggacaccttgcctggggctcagcacggtccctaccgcagactgagttccactgggacagcaaatcctgggtctgaggcacccacattctagacatccccaagccagggcacagaaacagcctcttcctcccggagtcctaatgctcaggctgctggctccctgggctgggcccctcggggtccctggcaacctaagaagcagttaaccccttcgcttctccacctcagggaagtctgaggacgtagtggttctattcaagcttctccttgcaaagggtcttattggggcctgcatcctgggcccagcctagccctggggctctggaaacagatgtaagtggcaaaggcagggcagaatgcctggccctggcagccgagcctccttgtgatggtgttggtgtcaccacccctgctagcagaacccagtctgcctccccttcccatgctgcagggacagggtctggagcacgcttccacctccctggtcacaggagcaagggaagtaatcagcccaggaagccgcgcgtttccttcctttctcaccagcccatccgggtttggtgagagagcatggacttgccctgtggagactgcagcttctggatgtgggaaggagagccctgcaggcagggggcttccaggcttgggacacctgggcattcctgggccaggtacatgcaccctcccactcagaaccccagagaaggactgcggggcccctgcagggctgcccatcagcagttcccaaaccctcactccttggggctaagggagcaatgtctctcccacaaccaagggggtggggaggaagaggagcagctccctcctccctcccgtccaccgggtcctctcatcctccctttcatcaaaaggcggaaggtggcctgagactaaggcgtggagcttccttggtcctgaaatcagagcggagtggctggatccagcccgcccctcccccgccccctgctccccttgccgccccaccaccgagaatcacctgcacctcccagccctgagcagagttgggggcaggcgggaatgaggtttctccatggccaactgctcagccactgttccccacgccactgccaccagaccctcactaaggggcctcttgcccctccctggtcaaatctgttttcaggaaagcacccaacaaacctgcaactcagaagccaaatgagacctatcccaggcaggtccgctctgcgatggtggctctcatacaccgcacagaagtgtaagttggcccccccctcactccctaaatccatgtagatgcccttagccaaacaggtctggtgtgtgggggcaggagggtggaggtaggagcatctgggggctggggctggctccaagtgctgcagagagttcactatgagctctgaagtcaaactcagatcctgctccttagctgtgtggccttgggcaagcccctcagcctctctgagcctcaggctcctcctctgtaagtggggctgttggagggatgaactgagatacacgtggcaaggtgcctggccctgagactgggggccccgtaaacagcacctgctgctctgactgaggggcagttggagatgaggggggacttacaggcccaacacctcatcagcaggatgggccctggctctgtacacatagaatgttggaaagctatgttctgggtccagttgcaagaccatcctgcccacttgctgggtcgctgaggcagagcgccctggactgtgctctggagagcagggggccgtctctgctcactgctgggcagtcagagtcaggtccccagggaactcagatcaaaatctcagggcagccttgctgggtctcagctttcagaattgatttctttggaagaacaggaggcatagccaggccagctggcaatggcttcagccacagtcccccagtgccccatgctgggtgattgatggtaggagctgtgcctccctgccagccccccaagccccattccctgccatggctccgacagggaactccctgcaattcttaggtggatcctgaaacacccagtccagactactttttcagcctcacagatggcccagagatagatactattagcccatttcacagatgggaccccagtgaggtctagagaggctctgctctagctgagctgggactcagatcctactccatgacctctgccaaggtccaggccctcttaccgtcctacggggtccttgccggtgtcctcagcctctgccttccagaccccaggtgtcctggagctctgcagatcagagaggctagtactggaagcctgggcccatgcccccagcagcccccagcccagggggcccccaaggctgaacagcaagctcaggatcatcttggtggtggggcaggctcagctcacactcagccttggcaagtagctccagaaactgctagtgacgttgtcttcaagttaaatctcaggaggaaaagaaaatacgaggacaacaaagagaggaagtggcctgggccggcctacccggtgggtcttgtcctgccccccaactaccctggctggccccacaggggccgccaaccacacaagccagttcctgtccctgaggacttggctcagggactctgggaatgtggtagacatggggtggccccaccaaatgcatccttatgggaacctgctccctgggagccatgaaaagagcgtggacttcgaggtggggccacaggaagtggtcaggtccatctcaggggacctgctgcccatccacactgctggccaggaaatggggggcaattcatgcctcctcagcaccttcagcactgggcggctcaaagaagggaagggactattctggggtcacacagcatgcagccagaggccaaggcatgaggaagtccttcatttccccacccccacccacctcagatcctccaaccggtttcatggcagcccagggtccagcggcatccaggatgctggtgggtagctgcacagcccaggccgcgggaggttggctgctctcacctaacaggcctatgtggccctgacccctacctaggaagctggggacaatggccaaggcgcctcccctctctgtgcctgtctgtccaggtgcagcatagacacagcacccctggggccaagagcacccagccagggctgcccccatgggtgggcagggcagtaaatgaatgagggacaggttgggaggtggccagccccctccagcccatggagggcacggggcaggagagctgggctgagccagcaggagcccagggagcctggtctctgccttcctatcctggaggaaggtgaggctgaacctccttccctccctccctccctccccgcccccactgcacgcagggctggctgggctccagctggcctccgcatcaatatttcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggtaagtggggcatggcagggtgggacagtgtggtggccaaagggtgagtgcccagttaccttcgccagaccttactccccagccccagggaggcattttgggagggggcgaggccctggctatcaaggtggggtctccagaccctggagcacccacaatgccctgtgcacacctatgtgtgtttgtctttggcctcctcggggcctctgggtgtcagagaccgcagacagggctggctacctgtctgtgcacgcacacacacattcccaagcataccagcctcccctgagcctggagcccctgaagccatgagcagcctgtgctcaggtggcccccaccctctccacacgggagcggctacagccaggtcacggatcccctccctccccagagagaaggggcaggctgggggatgaaacctaggctcagtgttccctcccccgcatcctctcctggcactctccagaggaggaaggggaggtcaagccaatgactcagctctggcccatcctgtcctgttgctgcttctgaggcccggccacacccgggcaggggctggaccctgggtctagccagtgtccctacctcaggcctgctctctcttgtcccccacattctgtcctgtccccttcccatccatccacttcttccagacacagcaggaagaggccctctgaaggggccgccggcccccagacaccatccttacccccccaccgaccccacagtttgtccagctgttctgttgtgtttgtcctgaccgcccccaacacctcgagggaggtctgggctgacagctccatttcctccccaggagccaagaccaaggagaatgttgtacagagcgtgacctcaggtgagaagccccagggccaggggacacatgggggataggacccctggggctcctgcatcctagtgctggggctcaaacctagagtcctgccttacccccaactggggtcccaagccctacagacccctgcagaccatgaggctaaactagggtgggcgtctccttacccccaccagcatcagaggtgccctggagtcagagggagcaggggagggtcccagcagggccagggctctgagctcctgggaaggggctgcgagcctgactccagcaggcctgccttggggctggggctggggtggaggccagccagtgtcctcccatagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggtgagccccggccctcagacctgcccagtcctctcctgggcccagaaaggctgctgggcggaggcggcatcactccactccacaccccaggaaacaacacggggggctgcggctggcttcagtttcagtacccactgagcgccggcatggggtggggtccatgcttgctgttcgacctgcattcgggtctggaatcaccacaaccaccccttcgggggacttgggagcccatctcatagacaaggaaagtgaggctcaaaaccacatcttccggacggctctcagcacttaggagacaccccattttataagtgaaaacaggatcccacacggtgacaggcagcctcccgggcagtggtcaccaggccgggggctgagtagcaccagccccgcccccagggcctagcctccctccctgggctgggcggggcagctgcctcctgctgggagcctcagggaagtagcgtcccctagtggtaagaaagcagtgctgcttctgaccctaccctctgcagctgcctttgtgtgtgtgtgcacgtgtgttgagtgagcatgtgggtgcatttgtgagaatgtgtgggtgtacatgcgtgtgaatgtacacatgcgtgtgcggcccaatagcagacagcacaggagcagtggggcgcaccccagggacgggtgttggctgggtgagctgtcccagcacctgtgacacagcaagctctgctttacgcattgtacgcttattagttcatttaatagacacaaaatccatgagacggtgtggaaactaaggcccagagagattaatgtgcccaaggtcccatggctagttcatgtgagcttggaattcccctgagcagcctgtactctgagagaccctgtggcagtgtaagtggtggcctgggctaggattcctacctgggggtggggcgggggagcagtgtccagctctcctacctgctccaggcctcctaggtggtggagtctgaggctctgagcactgagaatccctgcgttaggagtgggtgggtggaagggtgggggctgccctactcctcttggctctggggcgatgcccaggtgtctgcttccagggccagcacagggtctccatgtccttggagctggcagccgctccctctcctagttcccctttctcgtcgtatgaccttgagaagcaaaggaacctctctgggcctccgtgttctcatctgcaagatgggggtgagagtgtcggcctccctgggctgtgtgatgaggcagggccatgacctccatgaagcaattctcctggtctatgtgagcacccagcagaggaaggtgaccatcatcatcatcatcatcatgtgtcccaggcagaacacatagagccccagggggctcctccctcctcacccccagcaaaagaggccctggggtgagggtgcccgggcattccttgtgaatcccggagcagggctagtgagcccttggagccacctcgagggagactcatttcctggtgacaccccaaaaccagtcacgactcatctcccagtgaactgtgaaaggcctcagcagggactatctgaccactcatacccctggcctcatcatcagccttagggcagcaggactcagcaggtggccacctgccctgcccctggatagcctggccgactcccgccagcacagcactgcccttttatgccccactccgccaaggggcaggatggccctggggcaacacagaggtgacagtatccccgcctcccccccgtcccccgccagaggcaggtgctgaggccagagtgcagggcaatcaccagtgtggtcctacacacccagctgtcatgatatctcacgcaagtgtctggccggcatggagtgcaggagatagaagatgggaagtgagagaggactgtgtaacctctgctggccctgaccagcctgagcccagagcctgtccaggaggcaaagagagggagccatgctcctgtggactgaagtgggcctgaagcaagcctgatctgatgccaacacaccccaccactttgagctcgaaggccctgagctgcatgccaagcctccctggcctcagagtccctatgtgaaccccaatcagtcttccttgtagggctactgagggtggggtcagacctggggcttcaggggcctctgcccactctaacccccactccaccctaccccacccaggttcctcatcagtgaagcccaactaggggcttcccagagactggggaccagcttgaggggtgaagctgggctccagggtacttggtgcccctggaaggcctcggcatcatcagagccccgggtattgtctgaattgcacgcccccaatacctccagcccctccaagtacaacaaggccacgaggggcctctgctcctccttgaggccagggtagacaaggccctggttgcagggcagctaggggtctctgcattctccacatggtctcatgcccccttttgtcccctacaggaggacttgaggccatctgccccccaacaggagggtgaggcatccaaagagaaagaggaagtggcagaggaggtaggagctgggctcctggggtgcaccatggggggttccttggtagggaccccatcccccacagacgcactgcttccctcctgggctcccagggcccagaggggcctcctgaccttccacagcccctacagggactgtgtacagggctaaccctgaacctgagtgggaggtccccccacggatgacccctcaggcatggggcacagaagacaacttttctcagcccactcagggtggcccattaaggctggggcctggagctgggtgtgcaggtcattctctctcccaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccactcctgccatgcttcctctgggtgctgtgtagcttgaggaggggtccccaggtcctcccaggaacaggaacgggttcagcctgttgataggaccaggtatcctatagggacacacacagggcattcatgggacctgcgtgagccttcaggaacacccccaacccacccattgcctttaacatggaggaggcagcactgccttcggctccccaagacattcgacaggactcacagtcccatccacggggatagcttagctcagcctcaaggtagcccccgcctgcctgctctgagtccctgaggaacccactgtcagcaggaggtgaagataggctcctgggtcttccctccatgtgagttctgggctccagtgtcgcaagaggaacagggccacctaacatcctccctggggcagatggtgactttcaaagatggagaagtctaaacctagtgaggatgaagggcatcccacaggagagacagaaggtggaccctgcggcgcctcccacctggccccagccagtctcatgctccccgctggacctggagctgggtaccccttgcacccctcctgcacccagaagcctgccagttgccaccaaaaacacaacagcagagacgcacgaagccgcaccttgacagaaaaatagtaaaaagcaacagctgctgaggtcctcacaggcgttgactgggcactgttctgagcacttcaccttatttaatcctcagaataaacctctcaggttggagctgtagatccaggttttgctgagacgcacaggactgggcagaagcccaggtggctccccagccctgctatggctgcatggaccccaaggtgcttacagtggattgcccccaacccaaagtttcaaaacaacccagggcttgctggccagtggcctacatgaaaggctgtttgcccagcccactctgaacaagcctgccgggcacgacgcaaaccacccatcatgtaggccactggccagcgtgtcctgggttgttttaaagccttgcatgccgggcgggcttgttcagaccagggttccctggggatcctggcttcccctttgatactcagatggtttgggctcaaagcatctcagtgccttgccccaggccttcaggcctgggtgttggagccagagcttgagtccgtccacatgtgacttcagacactgccctgtccacaccgcctccccatccagcctctgcagtggattcaagggcagcccaggaggctgggagcccagtcagacacagcggagccaggctgtatctgttgtctggccatgggcatccactgaggaggcagaacggagcagggggctgctggtctccacatccccaagcactgccatgggcaggcatgaagggtctggaagcagctcaggccagtcagggctgttcctgctccccagcccagacatgtacacattaagcaggcctgtatgaacccaggaggaggccacctggggcctgggtgtgcccgagagtcccctgggctgtgagagaaagcaaggaggagcaaggctggtcaggtgatgggggtgagggagagggcacctatgcccggctcccagcgacaacctgccccaggtttcagggccctctgcctctgctggaggagcccagaggggtccctgctgcccctaccacagcccccctacaaccccctctcacatacactcagggcttgttcctggactcaaatgacaaacatcaccagaaagccccttcccagccatgggcactggcagtgctctttgcctttgaaacctcatgtgctctgcaccctgtgaggctgcttctgacctccctgcaggagcacggttgactccccttatccaccaggatacactcaagatgtttccagctgcctgcaaccccagatagtaccaaagcctacatatgtatcttcctacacgtacacatgtgcctccctatgatgaagtttatacattaggcacagtaatagactaacaataaccagtaagaaaacggaacaattataacaatatactgtaatgaaagttatttaaaacatgaattgtttatttctagaattttcttttttttttttttttgagacggagtcttactctgtcatccaggctggagtggtggtgcgatctctgctcactgcaacctctgcctcccaggttcaagtgattctcctgcctcagcctcccaagtagcagggactacaggcgtgcgccaccacgcccagctaattttggtacttttagtacagacagggtttcaccatgttggccaggctggtctcgaactcctgacttcaagctatccacctacctcggcctcccaaagtgctgggattacaggcaggagccatcacgaccagctatttctggaattttccatttaacattttggaccttaccaattgcggtgcaggggccaagggaaaacttcccctttaccctctgaaggttcactgaaaagtcagctcatgaaagcagaatagaaatggaatacacattcattagcatgcaaggggaaatcagagtgactgccccaccacgaaatggggtacagatgagcaatggggaagtgtgggtaatttcagggggctagtaaatgattttcaggggaattcagtgggcttgaagaacatacagtggcctgggacaaagtctgttgggctcacagagcagacaacggtttgcaaaatctgtccaggtatgtgagcaggcttcagtctttcttcctgtgacagcagttcagtcagagaaaactccgggaagggaccagtggtcattgttttcttctttggtgggtccagacttaaggcagatgaggaacttcagagaacaacttcactgtatgctttggaagagacaaagggttggggggcctgtgggagtctggtcggagagaccttaaggcttcttcagttcagaatgtcacaccactatatttcggggtattggtttctgagccccaacaatgagtaactgaaactgcagaaagcgaaatcacaaattagctgggggtggtggctcatgcctgtaatctcagctactcaggaagctgaggcagaactgcttgaacctggaaggcagaggttgcagtgagccaagatcccgccattgcactccagcctgggcaacaagagcaaaactctgtctccaaaaacaaaaaaagggaaaaaaaaaagtgacaccacagcaaactggggcgggggtgggggaaacggtaatgcggtaatgcgctccctccttctgcctctccttgtctgagaagccctggtgccctgcacgctctcacaaggtccactgctgagtcctgggcacccttcagccaatttaatcttcacacacacactttggggagacgctgtgatgtgatggggatgttgaggctcagagaagtgaggggcttgctctaagaatatctgaacccaagaggtttgactgtagtgcctgccgctagggccacgtggagctctctctaccaccatctgctgggggctggctgtctcttcccacagaggctgctcccttcctgtccagctcacagctcattgcccatggggcctggagcccagtggcaccaccagcctgtgataaactggaacactcgaaggcctgcctggctattgggcactaccggtgggatttcaggagggctggcagggctgtggccagccaggcagggcatggctgagatgggctccccagagtccccaaggcatccatatggccgctcccagggcaaggcctcgctctgggagaggaggggcggggggctgggaggactgttgctgccgctttgttttgcctgagacctgctccctcccccttcctccacctaatctcatcacctgcctcttccctttgcccagggttgacctcatctccattaatccataccgtgtgtgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccggtgaggatagcgcgcgacctagggctcaggcaggggcacctgcgtggatgcgcaggcagaagcagcgggtcggcgcggtccgcaagttcctggaccggcagcttggctcggaaggctcggtcctccactgagacgcagggggcaggcagaacgcccaccccggcgagcagacagatggtgcccgcagggaggcagcggaacagaggctccggaggagccggagctgcgctgcgggcactgcgggagcccctccaaggaggccatgctggcgctgggcggcccgcccaggccctcaggagagggtgaaggtccaggacagggatcgggcgcggcccgccaccacttaaacccgcgcgcgccaccagaggctgccccagacctcaaagggctttgtttccatcccacccccatcgccgaaaagtaatcgtcgccttacctttaagtccccacctggcaaagaaggtccttagttcctccacctccagctctctcctccgtattctggaggtgacccagctgcggtgggggcgtgggagatgtcaggagaccactgggttggttcttcctgcacctagcccaggcttcgttaggactccagctccctgtcagtcctgcccatatcccagtcaggagacaatatccaaaccaaccccttacttcaccagtgctccaggggaggcccacagttcttcccttgagactgaaatgctaccaaggaagcctccgtgtcaggtcccttccttctgggcttcacttttccatctgagagctgggtgcaaaggatgggctgctttctgatgggttaatcgagacgaggttcccaggggcctctcagcacacttgcctgactaaccctttccggaggatgggatctgggtaaggcaggccctttcctgttcagcagcagggatgagttacagctctgtaggcgggagccacctgtcagcccccccggggctggtgactccattcccagcaggccgaaactctggtccagaggagatagtccggccttggaagttttgcctccttccttcatttgtctcctaatgtcttaagctgcctgtccacagaggcactggctttgcttgtgtgcccctccgggcaggccacaggagggaggaggcagtaaggacctggcaaaactgcaagccccagggctaagtgcatgaaaggtgggaattcaggcatctgggccaggcttctaggggagaagctgtaaaagggggcaagggtcttctgcgccatcaccagcattagccaacagtccagatgctagctgcagcctggccctgccctgccttccttcctctgtccaacattttctcagtagccctggagatggaaagggaagctcctcccccacagagaaggagctcagagttagaaataaacaaaaacatcccagaggcatggaaaggtctcctgcccctcgggctggggggccctgggccagggactttatctccatggcatccatcccttggacctgtaccaccgaatactctggaggacacagaggcatggcaatggtggggcacctgtagtcggtggtgcctcaacaggggctaaaagccacatctctctgttccagtgtcagcggccggagcggcagctcagcaagtggtggaccaggccacagaggcggggcagaaaggtctggtggggctggagggaggcgggcaaccccagcacacctcccactccccgccccatcccggctggggcccaggcacatcctctcctctgcagagccctctgtccacaatgccccaagcaggtcccccgggagacccaggccaggctaagcctacaggcactgtggttcccgggccctgcctgacctgccctctctcccgcccttccccagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgcgcctcccgaagctcccagaccggaggctcagcccccatctcggttagtgcccctctcccgcccgactttagagccagcccctgccccttattccctgccccaggatcccggcccctcctgggagctgggctggactcggtcctcagatcctcggaaggctcagctctgggcggggcaagggaccttgcaagtcgggggggcctcgggaacttctctccgccagctgcgactggaggctgggaacaggggagacgacccagggccacggcccctcaggacttcaggcggccggaggttgtggggacgaagcggagtcgggagccgggcttccggccctcactaccccgtctcggcccgcgggttgcctgcgtgcccgccccacccagcggtgagtcatggggcagggcccgcgggaagctttgttgagtggggcgctgccgcccggcggggtcccgccccgccactccccggggaggggcttcggggcacggggccgtgcacgtgagaacgaagcacggttgtggggggggcatgcacgtgcgcgctcgcgtgcgggagacccctcccttccacaccacttcctttcgggacaaaccggtaacctccggccctggaaggttttgtctagtgggttccggatggactggtgttcccagcacccccccggcacgtgtccacgcgtgtggccccggtacggtgtatgccttgccagtaggtgactcaacgtggcactggttgagcgccggatgaggcctggccctggcgcggggcgtgggctgctgcggccctttcctccccgcgcccctcacgccccagcgggcccctagcggttcccgtccacccgctccatgtctttaccccggtactacctccacctgcagtcgcctcctcctgcgcgccagtggcctctgcgtttctgttgaaaggtaccgactacgcggtgcttcccagttctgaggcgatttagtcagcggactcaaggcgcgctccctgccttccccggcctcccagcaggggacgaagtccccaacctggctgccagtccagatgctgcagtacaggtctgcctaggaggccgttcccttctccagtctgagatctccctcgcggggcacgtgtctaccacccttaacccagggctgccctggttccactatcggttacatgttgctgactgtccccaaaaggtttctttgtagaatgtgggaaagtccttgaagagacacccggagcagtgtcaggggcgcttccaggagcccctgcctccaggagcaggtcctagggtctggagagccggcctcagggccactccaggaggctggtggggctggactggcagagcccagcatccttctggtgtgcatcattcccctatgactcagggatgaatcccaagggacttttcacttgttctccttgtgagtgatcgccttaagtgcgacccaggtgcggccaaggagagagatcaggcctgaggccaggagtcttctagaaaaggcttttcttgtcttgaaggcggggcatggtggctcagcctgtaatcccagcactttgggaggctgaggcgggagaatgacttgagaccgggaggtcgaggaccgctgcactcagtctgggcaacagagtgagaccctgtctcagaaaaaaaaaaaaaagccgcccttcatcttcctctggacaccttgtggctggaaaggaaccctagaaccagccacttggaaccacaggaggaacaagtctgaggaacaagtctaaggaaaagcccacctgctgatgagggcagagcctcccagacctccagcctgttcccacaacaccccctcccttccatctcagccaccttgaccttcccatcatgctcctgctgcctcggtatcttcacacctgcggcattttctgcctggcatactctccataaatcacccttgcctattgctcttccaaacgtcaggtctcagcggccttgggtgtgccgacacacacacacacacacacacacacacacaatatgcatcaggcccctggtgacacattctcacaccccctgtacctcctttttagagtcacaatgagccttcatgtgtgcttctccatagtggtggttcatggggctgtaaccagtccctttttagtgcatgctctgtgtcttctgcggtgctcaggcagcactggctaaatgattgcatggaggaccatccttttgttctcctgatggatgacagtgagttctcattttcaggtttaccatggaaccatctctgcaatgcagccccttccacattgccccagccccatggagctggtgctccggtggcgctgtgcaattgcctgttcctgtgtgcctctgctcccccgacactaggagccctggagggcagggccaggtgggacttgccttttgaaccatgtctgggacacagagggcacagagccagtgtctctgtaataggtcccttgcctgatggcagggcaagtccatacacccgaaacaccgggttgcagcagaagaaagaggtttagtcgcagggctgccagacaagatgggagaaaacctcaaatctctctccgagaagtttggggttagggttcttaagagttttagagcaggccaaagtgtggagattgttgatttgttgaagagtgcggagtgaagtcatggggccagggagatgaaaaaactgtattctcatgctgattatgttcttctgggctgttcaaactggttggggtcacttgtttcactggaatttggaatctgaaaaacattttaggctggatgcggtggctcattcctgttttcccagtactctgaaggccaaggtgggcggatcatctgacgttaggagttcgagaccagcctggccacatagtgaaaccctgtctctactaaaaatacaaaaattagtcgggtttggtggcgtgcgcctgtaatcccagttacttgggaggctgaggcaggagaattgcttgaacctgggaggtggaggttgctgagccaagatggtgccgctgcactccagcctgggcgacagagtgagactctgtctcggaaaaaaaaaaactgaaaaaacaaacgaaaaaaacgttttaaggaattcctaaacaaaagcctatgattctaacatcagaaagccgaactgtgggaacagtggggatgcagatggtcagtatacagtgccacgggaagttctatagaaggaatttagttaaagcacagcctcattaatgcttaattataactgttaatttttaattataactgttaatgcttaattataactatatttctgtgtagaatgcttgttaaccctgtgaggacagcttcaccagaggagcccttgggagcttatactgcccaggcctgtctccaccaggttcatggagcaagtacagcccagactggctgaggaggaaggattgtggccacactacacctattgggtgtcagtcagtcctccagagatcaattcttccattagcaatgccacacataattcctaattctccaaattccagttccccatctagccaaacacacagtcactaacattacattgtggttccacttacaaatgactgcattttcaggtggaggtgttcccttaaaccattttctctggatggcgttccttcctccctcttcttcttcatccccattttcagtccgtaggatgagcttctttgtatgtaatctcccaaacgtctaccgctggagttctcagctttgacccccatcagactacacatgaggcagggtgcagattcttccactttcacctcctctccccttctctccctccgccgcctttttaaaaaatgttacttgtcccatttctacattgtgaaaacacgtagagttgcattccattcctcagccctgaaccacacctttgtttttgtcttggatctgcaattgaagatattaaaagctgtttgccattccttctgctgaatattttctgctatctcttggttggttagaattagtcctgcagagtcttctctctctctctctctctctcttttttttttgagacagagtatcactcctgttacccaggcaggagtgcagtggcacagtgtccgctcactgcaacctccacctcccaggttcaagcagttcttctgcctcagcttccggaatagctgggattacaggtgcctgccaccacgcctggctaatttttgtatttttagtagagatggggtttcaccattttggccaggctggtctcaaatacctgatcttaggtgatccatcagccttggcctcccaaagtgctggaagtacaggtgtgagccaccgcacccagcccagagtcttctcaagaatgaaatagttaaagatgataaatgtttacagagataagacatctgatatctgagttaataatttctataactgggtaatgggtccatgagggttcattttatttatatatatatatatatttatttatttatttatttatttttttgagacagagtcttcctctgttgcccaggctggagtgcactggcatgatgtcggctcactgcagcctccgtctcctgggttcaggcgattctcctgtctcagcctcctgtctcagctcatgcctgtagctgggattgcaggcatgtgccaccatgcctggctaatttttgtatttttagtacagacagggtttcactatgttggccagactggtctcgaactcctgacctcaggtgatcctcccacctcagcctcctgaagtgctgggattacagtcgggagccaccgtgcccggcccattatattctatttttgtgtatgacattttctatttttaaaacggtaaaaaagttaaaataaaaattttataaaaagaagggcttatgtgaacagtattctgatttttaaatgtttggttggtattgttagtctgtagcctttagactttatccctggctgggtttgaggtttgtggctccctcttcagcttcagtgtcttctaggtgtggctgcaactgccttctggcacagaaggttgagcagaccctacatgtctgatgcacactgaaatttctttttttatttttaattttaatttattatttattttgagatgggggtctcactatgttccccaggctggtctcaaactcttggcctcaagcagtcctcccaccttggcctaacaaagggctgggattacaggtgtgagccgctgcaccagctccctactggaatttttttttgtagagacagggagggtctggctctgtcacccagattggagtgcagtggcctgatcatggctccctgcagcctcaaactcctggcctcaagcaatcctcctacctcagcctcccaagtagctgggattacaggtgtgtgccaccatgctcagctaattaaaacaaatttttttttgtagaggtggagtctcactatgttgtccaggctgatgtcaaactcctgagctcaagtgatcctcccacctcagcctccccacagcactgggattacgggtgtgagccactgtgtccagactcctgcaggaatttctaataagcaacatgatatttctggcttgttttctttctttaagtttaaagtacaataatttttctagagtttgtctcaatgattatggctctggttcattgttgcctggtgtgcagtttgccctttgaatactaattcaaggctgggcgtggtagctcaggcctgtaatcccagcactttgggaggctgaggtgggaggatagcttgagctcgggagttttagatcagactgggtgacagtgataccccatctctacaaaaaataggaaaagtatccaggtgtggtggtgcacgcctgtagtcccagctacttaagaaggctgaagtgggaggatcccttgagcccaggagttgaaggctgcagtgagccatgattgcgctactgcactccagcctgagtggcagagtgagatcctatctcaaaaaaaaaaaaaaagtatatatgtatgtgtgtgtgtgtgtatatatgtgtgtgtatatatatgtgtgtgtatatatatgtgtgtgtgtatatatatgtgtgtgtgtgtgtgtgtgtgtatgtacctgtgtatgtgtggtgtatgtatacatatacatatatacccagaagacagattgttggatcataagttagctctatatttaattttttgaggaatccccatagtgtttttctttctttctttccttctttctttttttagaccaggtcttgcactgttgcccaggctggagtgcaatggcacgatctcagcccactgcaacctctgcctcctgggttcacgcaattctcctgcctcagcctcccgagtagccgggatgacaggcacacaccaccacacccgctaatttttttttttttttttagtagagatggggtttcactatgttggccagactggtcttgaactcctgacctcgtgatctgcccgtctcggcctcccaaagtgctgagattacagatgtgagccaccacgcctggccttccatggtgtttttcataatggctatatcaatttgcattcccactaatagtgtacaagggttcccttttctccacattctcaccaacacttatcttttgtcttttttttttttttagagatgaggtctccctgtgttgcccaggcaggagtgcagtggctgttcacaggtgtgaacatagcacactatggcctcgaactcctgggctcaagtgatcctcctgcctcaacctctggagtagctaggactataggcatgcaccactgtgcccagctcctgcataattgtattttaaaatatttgctctgttccattgctcagctttcttctttgggaattccaagtgtgagtatgaagttcttttcttcctactttccatatctactgttgtctcccaaatactgtgtatctttttcattcctttttttctttactttttccatttctgttctataggcatctacggtggtatctaccttcttgtgcttcttatctgccatggtttgtttagtcttttttcttctattcatttctgagatatatttctcttctgcctgctcttgctgtctggccatctcctctcagagttctggcaactgctttacagtcttccttcataacagctgttgtttattaagtgtcttcttttcttcctaaaattcatgttggaatgttgactattctttttccatatttaaaaatagtatgtttttactcttaactagaaaaaagggaaggggagaagtatatatctatggtatgctgtctttctgtaagaaagagaggatgggccgggcacagcggcttatgcctgtaatcccagcactttcggaggccgaggcaggcagatcacgaagtcaggagttggagaccagcctggtcaacatggtgaaactccatctctactaaaaatacaaaaattagccgggcgtgatggcacacacctgttgtcccagctacttgggaggctgaggcaggagaatcgcttgaacccaggaggcggaggttgcagtgagctgagaccgtgccactgcactccagcctgggtgacagagtgagaatccatctccaaagaaaaaaaaaaaggattaaagaaaatacaatgtctctgtttatttgtagaaagtgcaggaaggccagtcacagtggctaatgcctgtaatcctagcacttgctgaggtgggcgggtcacttgaggccaggagtttcagaccagcctggccaacataacaaaatactgtctctactaaaaatacaaaaataagccaggtgtggtggcacgtgcctataatcccagctactcaggaggctaaggcatgagaatcgcttgaacctaggagggagaggttgcagtgagtcaagattgtgtcactgcactgcagcctaggtgacagagcaagactctgccttaaaaaaaaaaagtgcaagaaggataaactaggaaataaagggattgggggattggttacctatagggggcaggtggcaaaggggtggaaagagggagcgaatgggaacaggctaacagggataagaagagagtgacacttatctgaatatatctttttttgtggttctcagaaccatagtaatgttcttatactcaaaatatagacaaagcaattaaaaccaaccagaatataggggagggaagtacccaaaatggaatacaaacactaaaaagtgaacctaactctactacaaatgaaaataaccacactcaaaagaaaaaattcaagtaaccttgaaaatcagtatgttgactggattctgtagggttaaatgcagcaaacactctccatacattctgtaatctagtcagtaaatgtatactttctcataggattgtgggtaagcaattctgagacaactttatatagtagaattgaatgcataagtaagtgtatcataaataataagaactgggtttgtcactattggataaagaaattaaaataaaaaccagggaaccctcttccagtaccccatgtggtgttgtattggaatctgaggtatcaatataaactcaggatttttaatttttgtactaataaatgcagaaatatagctgggcacagtgactcatgcctataatcccagcactttgggaagcctgaagtgggcggatcacttgagctcaagaattgaagaccagcttgggcaatatggtgaaaccccatctccacaggagtggaggaaaaaccaggcagagggacccccaggacattgaggggctctggccgctgtatgggacacgcttctggaaacttgcccctaatagggcatcaaagccaggcaggcaggggctcctctgtcagaggttggaagccaggactgcatcttcccatcttacttttgggatgcaggtcagctgttttccctcagatgagaggttccaattttttgtttgtttagtttttgagacagagtctcgctctgtcacctaggctagagtgcaatggcgctatcttggcttagtgcaacctctgactcccgggttcaagcaattctcctgcctcagtctcccgggtagctgggattacaggcacacaccaccatgccaggctaatttttgtatttttagtagagatgggatttcaccatgttggtcaggctgggaggttccaattttataagatgagaagaagggctgaggtcatgcccattctgccactttgctgagtccagagctatgatgaagtgaagaagaaggcacagggcaggacaaagaagggagctcagggacccgggagttttccttggcagaagtcaacttgccccacccctgagaaaactctgaccttctcagctgccagggaggaacgcagggactggggaggaggggacagggaggggaacagtctgctgctctgtgccctgggagagaagtctgatgacggcagtaactcaggaagggttaagaatattcctaaaatagccaagccacagtctaagccagtccatgagcagagagcagatctgtagcaggaaaagtcagcctgatctttgccccactgcctgctgcctagccctggctgctaattaagcctcctaccctgtccccttcaccaattcctcttgtcctagtggggatggggtaggagtagtcagaggagccaaatcaccccaatcaacagggaactacagctgggaccaggagcactgggcccagtggccccccaatccacactcctggtctgagagtcaggtagggggacatagggagaaagacaggcaaagtgcaggctttgtgcatgggatggaggctgccaagagagagcagccaaattctcccacccacacacatgcatcgccagccatgatcaggtgggacctccaagatcatcatcagataccgccttctcctagctctgtgttcccctacacttagggcatcttggagtgagacaggcagggaggggttgagggagcccctacatgaacaaaccatatctttgtttcaggggcaggaccaggtatataatttgcaggacccaatgcgaactgaaaatgtggagtctgtcattcaaaaattgttaagaatttcaaggcagtgacaacagagcattaaaccaagttcaggtcccctctgagtgtggggcttttgccactgcacaggtggcacctttatgaagccatccttgtgcagggatttggtttaatgaacatttactaagcgcccactactcagctcttctggctctgtaacatggtctggctctgtgtccgcactcaaatgtcattttgaattgtaatccccatgtgttgggggagggacctgtgggacgtgattacatcatgggagtggttcccacatgctgttctcgtgatagtgagtgagttctcctgagatctgatggttttatagggggccttttccctcttcattctgcacttctctctcctgctgccatgtgaaggacgtgtttgcttccccttccaccatgattgtaagtttcctgaggcctccccagccatgtggaactgtgaatcaattaaacgtctttcctttgattaacttctaatctataactaaggtctgagtcctgaagaccttcctctggagcctcagtaaatttattttatctagatgggtccaggtgctgcaggtgattacccttatcttgtctcctgcaaaatcatggaggtttggggaattctttagacttcctctcgtgtggaggtttgttttcttcttttttctttcctgcaaggacaaagtgaattctgtgatggtttatgtatcatttttgagtttattgccaaaaattgaggctcaagtttgtagactacatttttaaataaaataaaactttctagacacagaaatgtaggtgaagctgttcctttgataccattttccgaatttacacagaggtgatagcaaatttttctctttatctttccttgaattgtatatatgcatataaatgctcttaaattcttagtgcaacagggtggattgtcattacagagaacgttcttagcatagagtacaaatcttcccactgctgactaggctctggtcacatagcaccccgagctggccttcaacttccacttctcggttcttttgcttaccttctctatttctagaatggctttgtcatttcacttgtctgtctggtaatatcctactcctgtaagaatcagtgagttcttggtacatactgatctaaatttgcctccggtttgaacctttttccagttttccaggtaaagttgatttatctgtcttctatgtttccataacaatctttccaagcataatacagtaaaaagagagctgattcatcatgtcctgtccatttccctctggagactttggagccgacgtgagggtacaggtgtgcccctgtataagatctttggtcgcctttgtcaagtttagcgcagttctcagtgtgtaattgttatcaggtgccattaaactggacctgaataattgaaggattcaaagtgttcaggaatcacccaggatgcttcaatacttcatcctaattagggatatggggaaagtttgcatgagaaagaagtttttttttttttttgaactttaaggataagttaaaattcagtaggcagaatgacaatcttgataattttttattttttatttttatttatttatgtttttttttgagacagagtctcgctctgtcgcccaggctggagtgcagtggtgccatcttggctcactgcaacctctgcctcctgggttcaagtgattcttttgcgtcagcctcccgagtagctgagactgcaggcatccgccaccacacccggctaatttttgtatttttagtagagatggtgtttcaccatattagccaggctggtctcaagctgctgacctcatgatccgcctgccttggcctcccaaagtgctgggattacaggcatgagccaccacgcccagccattttttattttaaaatgttcattttttactattttgatacaataactattttttaagaaaaggcagaaatcactgtttattagaaggcagattttactgatttttatacccctagatttgttgcatgtcaaacctatataaaacatctataaatcaaatcgttaattgcccctagtgtaataattctatatatggatgtaatgtttgaatcttcaggagctttgataacttgaaggccttttgattgctttaaaattaattctcattgtatttgtttatattgtatcgttaagcaaaagtacagagtaagcaattagtgtgattaattcctcttctataatacagtaaagcactgcctccctagaccaattctctgggatccctggaagacatctggcatccagcaagtcttgacccctctttagaaagccatggagaaactggaggcaattctgttaagtattcgctctctagaggcaattccattaattaccctccctcacctatccatgacacaatttctccagttacatgtagaaggctgttatgtgtctcttggccagaccctttatttcatagatgtggaaattgaggccctgaaggatgaggtgagtgttcagagtccacatgactagttaatgcccagaacctggcctggacttctttcttgttccggggcattgagttctctccctcttctttagcacgtatggccagaggtaacataatctgcgcatcacatttgcatttggagtgcatctgttttgcattcatttaatcttgttgagatggtttgcttgttgacctactcagtcagttatcttttcacctttgtgagttgagagctttgtgtattaagtctgtaaaactttgcatcttggaaagtgacataatctgtagcagacccatgctgttttcagatgcatcttaattgtgatagtgatagtgatccaggagatacacatgtttttctgtgctatttcagaatacgccttcttaatccaagtcaagatggagtcaaaaacaacagactactacatttttgtttattttatttaggtaaaatacctgttttctgacaagactaggactcttacatagactgccatgaactacaagaagtatagcattgctcaaataacctgtggtaagtgtatttatcacttattgaacattttacttgcattctttctacaaaatgagtttatttttagctattgagtcaaattatcttgactttctgatgttttgatagaatatttataatagatttaggtatttcgttcatattgaatgtttttaaaactaaatgggtcccaaaggaaactgaacagttaaaacatgatttacttttgcaaatattaacctaatgagaaatcccagggaatctgcacatttgtgttttctatctagcaattattaatttcttagtgtatgttttgatccaactttttttttaatatatgctagcagatttttctaagctttcttaaaactgtcataaaatatttgtaatactaaggtcaagaatttaatttggtatcatagatctaactcattaactgtatttatttatttattatactttaagttgtaggttacatgtatacaacgtgcaggtttgttacatatgtatacatgtgccatgttggtgtgctgcacccattaactcatcatttacattaggtatatctcctaatgctatccctccccctcacccaccccacgacaggccctggtgttctccatcctgtgtccaagtgttctttgttcagttcccacctatgagtgagaacatgaggtgtttggtttttctctccttgcgatagtttgctcagaatgatggtttccagcttcatccatgtccctacaaaggacatgaactcatcctttttatggctgcatagtattccatggtgtatatgtgccacatttttttaatccagtctatcattgatggacatctgggttggttccaagtctttgctattgtgaatagtgccgcagtaaacatacgtgtgcatgtgtctttatagcagcatgatttataatcctttgggtatatacccagtagtaggatggctgggtcaaatggtatttccagttctagatccttgaggaatcgccacactgtcttccacaatgattgaactagtttacagtcccaccaacagtgtaagagtgttcctatttctccacatcctctccagcacctgctgtttcctgactttttaatgattgccattctaactggtgtgagatggtatctcattgtggttttgatttgcatttctctgatggccagtgatgatgagcattttttcatgtgtcagactgtcttttgatcacagttttgtgaccactctgttttccctttctctggcagtcacttcccggaattgacaaggaattcatcctcaggtgatttctgctaagtaaatcctagcacttcttgacactttagaaaaggctttggaataattttatattagcatttctcacctgcatatttttacatgtaaatacaagttgtgtatacattactttgaaagagaaccaggataaaatttaaagaaacatggttttagaagtccaatggtagtataagacttcacaaaaaacagactgctcttgattcagtacttcctacttactctccagatgcagccaacttcaacaatttttacttttaaaaaaatctctttttagatttcaaaataatatgtttatgtgtgtgacctgtctctcccccatcctgccctactctggctttaccccctgtagaagcatttaaaattttctgcatatccttagcatatactgttgcaattatggggtaggcttttttttttttttaatttgtgcatttaatgaacccgtagtggtacatgtctgtttttcttgttaattcttgggaatgtctttctgttgtttctataataattttcttcccctccagcttccctgtttcttctgagtctcttgttagatattgaacctcttgagttgatctaatttttgtcatcttcctctctcattttttgtattttgtgtttaattttctggtatctaattcaccttgattttctatctttctggcgacattttctttttttttttttttttttttttttgagacgaagtctcgctctgtggcccaggcgggagtacagtggcgcaatctcggctcactgcaagctccgcctccagggttcacgccattctcctgcctcagcctcccgagtagctgggactacaggcgcccgccatcacgcccggctaatttttttgtatttttagtagagacggggtttcaccatgttagccaggatggtctcgatctcctgacctcgtgatctgcccgcctcggcctcccaaagtgctgggattacaagcgtgagccaccgcgcccggcctctggcgacattttcatatgctctcacttttcagttgtcaaaagtgttctcttgaccttgcccttgcattctgttttctctgcccacctcttcgattctccccattgccgcctggtgttttggtttcttaattttattttataggctttcttcaaaggcctggtgatcatttgctgtgtgcttatatatttttattttttcactgggcaaaatacatgtaacataaaatgtatcatattaactattttaagtgtacaattcagttgctttaactgtattcataatgttttgcaatgatttccaccattccattctacaactttttcatgtgaagctctgtacctgttaaacagtaattcctaactccagtcgtcttccagtccctgttaaccaccattctactttctgcctctatgactttgcctatcttaggtacctcagataagtggaatcatacagaattgtctttttgtgtttggcttatttcccgtagcataaggtattcaaggtttcattgttcatccacattgtggaatgcgtcagaatctccttcctttaaaaaggaataatattctaataatattccattgcgtgcatatatcacatttgtttatctattcatctaccggtgggtatggtgttgcttccaccttccagctactgtgagtaacgctgctgtgaacattgctatacaaatatctttttgggtccctgcatttaattcttggggctatatacctcaaaatggaattactgggtcataccataattctgtgttcaactttttgaggaaccaccatgctgctctctagagcagaccaccactttacactactattagtaatgcacaaaggtttcgttttctccatatccttgtcaacacttgttatgttccatcttttgtttgtttgcattataatagccattttaatgggtgtgaagttgtacctccttgtggtcttgctttccatttcccttatgacttgtgatattgtctgcacatagtttaaggtttatacactaacaaagctgattactagcggtgtgtgtgtatggggaactgtgtggctgccgagtggcttccctgtgggatgatcagccagaacccgctattgtattaggggatccccagacatcagtgtttatagttctttttagtttttacgggtacatagtaggtatacatatttatgggggacatgagatattttgatacaaacatataatgcataataatcacatcaaggtaaatgggatatccattatctcaaacatttatcatttctctgtattataaataattcagttatatgcagttattttaaaatgtacaaaaaactattgctgactatagttaccctgttatgctaccaattagtagatcttatttattgtaactatattttgtacctatttactatcctcatttccccccaccaactatatttcccagcctcaagtaacaaccattctactctatctttgtgagtttgttttaatgtttagctccccaaaatgagtgtgaatgtgcaaagtttatctttctgtggctggcttatttaacttaatatcctccagcaccgttctgtgttgtcactaatgacagaatctcattctctgttatggctgaatagtactccattgtatatatgcacattttctttgttcattcatctgttgatggacacttaggttgcttccacatcttggatattgtgaattagtaatgcagtaaacataggagtgcagctatgtctttgatatattgattttctttttcatgtatatgtctaacaatgagatttctggatcctatggtagctctatttttagttttttgaggaacctccaaattgttctccatagtggttgcactaatttacattcccaccaacagtatgcaagggtttgctttttttccatatcctcaccagcatttgttattgcctgtcttttgaataaaagccattttaactgggatgagatgatatttcctcatagttctgatttgcatttctctgataatcagtgatgttgatcaccttttcctaagtctgttagccttttgtattttttcttttgagaaacgtctattaagatcttttgcccattttaaaatcagattattagatttttctctatacagttgtttgagctttttatatattctggttattaatcccttatcaaatggatagtttgcaaatatgtttccccattttgtggattttctctttgttgattgtttcttctgctgtgcaggaagctttttaacttaatgggatcccgtttgtccacttttgctttggttgtctgtgcttgtagggtattgcttaagaaatcttttcccagtttaatgtcctggagaatttccccaatgttttcttgtagtagtttcatagtttgaggtctcagatttaagtctttaatttgttttggtttggtttttatatatgatgagagataggagtcttgtttcattcctctgcatatggatatcctgtttttgcagcactatttatagaagagattgtcctttctccaatttatgttcttggcacctttattgaaaatgagctcactgtagatggatggatttcttttggattctttattgtgtttcattggcctctgtgtctgtttttatgccagtagcatgtcgtttgggttactataggtctatggtataatttgaagtcaggtaatctgatccttccagtttatttctctatgctcaggatagctttggctattctggactttttgtggttccatatagattttagaattattctatttttgtgaagaatgtcattgatattttgataggggttgcatttaacctgtagctttctttgagttatattgacatttcaacaatattgattcctccagtccatgaaggtggaatatctttccatttttggtgccctcttcaatttcttgcatcagtattttatagttttcattgtagcaatcattcatttctttgattaagtttattcctcattttatttgtagctattgtaaatgggattgctttcttagcttttttcaaaatgtttgatgttcacatataaaaacgatactgatttttttatgttgattacgtatcctgcaaatttcttgaatttgtttatcagttctaatagttttttggagtctttaggtgtttctaattataagagattgtctgcaaataattataatttgatttatttccaatttggatgcgttttatttccttctcttgtctgattgctctagctacgacttccagtacttccagaaaaagctcaattaatactgaattaacagtggtgaaagtgggcatctcttgttctagatcttagaggaaaggctttcgttttttttcccattcagtaagatactacttaatgggtgtgtcttatatgggttttattgtgttgaggtgtgcttcttctataccctgttttttaagcattttcacaataaaatgttgaattttatcaaatgcttttacagcatcagttgacatgattatataatttttgtccttcattctgttgatatgatcaccttgatttgcatatgttgaaccatccttctattcctgggataaattccacttggtcattatgaataattttttaatatgttgtggaatttgttttgcttgtaaattttcttgaggatttttgcatcagttttccttagggatattggcctgtagttttcttttttaatgtgtctttggtttaagtatcagccatcgaaatactcctccctcctctattttttggaatagtttgagtcggattggtattagttcttctgtaaatattcggtaaaatacagcagtgaagctattgtttttaggattttctttgttggtactttttattaaggctttgatcccgttatttgttattggtcggttcaggttttgaagcttttcgtgtttcaatcttggtaggttgtgtgtatctaggaatttatctatttcttttaggttttcgtgagtctttttggtgagctggtcagctttcttctcatgaaaatgacttagttttctgctaagggccacacatttgactgcaactgttatggaagctgaatggaagcagaggcttgataattgtgcctgtcagtgtatgtagaactcactttaaaaccctgtttggggaggatactgtagcctatccgtatgtgtgcctgtgagcccagtgtccctgggctcagggctactgtggtttaatttctctaaaagataaaccttccatttgtttctgctagtggaaggtttcgttgtctggctgcataggatgagggagggttcttaaaggtggagtgctcctcaaatggactgtcaacttgatcttctgtccttcatagtgaagtttctgtatcatctcatgttattttcaaaagcattttcctacccttgcctttgcattgactgcccagtcttccaccttccctgtacctcacagttacctcatgtgccttacaggtaccttgtgctgtaatttcttcaggtttcacagggttctgttaggagaacagaaacagaaggaggtaatctaagtaaacctgtacctattaaataaatcaaaaactgataatcttccaaaacagaaagcacttggcccagatggtttcactggtgaatttcatcatttaaggaagagatggaaccaactttctgcaatctctttcagaacataaaagtagaaggaacactctctaatgcattctataaggctagcataaccctaataccaaaagcagataaaaacattacaagaaaggaaaaccatagactaatatctcttataaacagagaagcaaaattctcaacaaaatattggcaaattgatagctaggtgtggtggctcatgcctgtaatcccagcactttgggaggctgaggcgggtggatcacctgaggtcaggagttcaagaccagcctggccaagatggtgaaaccctgtctctactaaaaatacaaaaattagccaagcgcagtggcgggtgcctgtaatcccagctacttgagaggctgaggcaggagaatcacttgaatccgggaggcagaggtcgcagcgagccaagatcacaccactgcactctagcctgggtgacagagcaagactccatctcaaaaaatatatatatatacacacacacacatatatatatatatatatatacgtgtatatgtatatatatgtatatatatgtgtgtatatatacgtgtgtatatatacgtgtgtgtatatatatacacgtgtatatatatatacgtgtgtatatatatacacgtgtatatatatatacgtgtgtatatatatacacgtgtatatatatatatacgtgtgtatatatatacacgtgtatatatatatatacgtgtgtatatatatatatatacacgtgtatatataggcaaattgaatgaaatattatataaaaagaattataaatcacaagagagatttattccaggtatgtgaagctagttcaacatttgaaaatcaataaatgtaatccatcatatcaaagaagaaaaatcacgtggtcatatcaataaataaagaaaaagtatgtgatatccaacacccattcatgatgaaaactctcagcaaacttggaatagaggggaatttccttaacttgataaagaatagctacaacagcaaccctgcagctaacataatacttcatggtgagaagctagacgcctttcccctaagatttaaaacaaggcaagaatgtcaccctcaccactcctatttaatatactggaagttctagcaaatgtgataagaaaataaaataaaaggtaagaaaggaaaaatatagatgagaaaggaacaaataaaactgtctttgctcacagatggcatgattgtctatgcagaaaatctcaaagaatcaacatatacatcatctcttcataatgaaatatatgaaatatactgtttttccttgggtattggctggattgtaaaatgcttctcccaccttcttaccccaaccttcttccttgtaggttagagttacttgttattggtaaatagccactgtggagactaaggaccaaaagaaacacagaaagaaattttacagaagaaaaacagtgggcccaaagctgaaaagaaaaagaagcagcatctgcaggatctccagctaggggatgaagaagatgtctggaagagaaatcccaaagcttttgcaattcagtctgctgtggggatggcttgatcctttcacaggtatgtatagctgcagtctgatgcttcttccattgattctttttaaatagtaggagcatctcacaggtgacatttggattcacaagtttagtcacactccaaaggacatggagatgcatgatgtgtggcttttactaaaacatgagaagacttcccatagaagctgtcttgcctccagcatctgcacactggttggtgtttcttgcccaagatacaagaatttatggaatttgtttcttcctaaactttaaactgtttctatggtgataagtgtgctttttccctccagatatgttttacaaagttgtaatataaaatacaaaaattacaatttgtaatgctaacatagctttagtgagtccttgtgatatgcctagcagtgtactttaaacattattcaactaaatacttccagcagccttaccagagtaggaatcattcttgccttcattttatggataagaaaactgaggtcaagaaaacaagttacctccaatcataaagccagtaagtaggagagccaaatttaactccagagcctctgatcttatctgttacgatgcactgcctcggtatttaccttttgtttttaaaaaaactattaaaatcactcataaaacagtcagatttaaggagtgtttaattttcaactctttatactattgaagtcatcttgctacatctttattgaacagcagttatttggatgggggccagtagttaacaaattaataattgacaggttaattatatttttatattgtctgttgtactctctataaaatatactaaagtactcatatctataagtaaactaaaaaaagtctacttataaggttgataccttttactctattttgaaaatgagtttacttttttttttaatgaataggactcaggatttgaagacaaaaaagcatcatattccagtggttgatcagactccactagagccgccaccaatagtgatagtggtgacggggcctccaaaagttggaaagagcactttgatataatgcctcattgggaacttcacccagcagaagttgaccgagatcagaggccctgtgatgatcgtgtcaggtaggagatgccaccacagccacagagttggcctggctgttgtcatctgagggagatgcatgtgttttctgttttcttgagtggaacatgttaaattttgtcatatcatgttaactctcttatacttttactaagttagctataacttcagaaaagggtaagttcccagagataaggatgtgatacatatcttatcctgactgctgtatggctttgccaagcatgttgcttggaagggcgtagcaggcctggtcactgtgaacatatcatttaacaaatagcatgtacctcctatgtgccaggtgcacatgcttgcccttatgaagccacatgctggtggaagtgcgcgttttctctttttcctgtgagaatttgtctgctttgggagatggcgacctttccaagtttgagagaagatgaaacaaacttccagtggtagaatggcaatgtacactctgaaacctcttgttattgcaataatatagttggattgaggcttttctttatctttggagcatccatattttcttttcctttttttgagacagggtcttattctgtggcacaggctggaatgcagtggcgtgattacagttcactgcagcctcaacttcccaggcttaagcaatcctcctactttagcctcctgagtaatgtatgccaccatacctggctaatttttctttttttttctttctttttttttttttgtagagatggggtttccccatgtggcacagggtggtctcaaaactcctaggctcaagggatctgtctgccttggcctcccaaggtgctgggactacaggcatgagccactgtgcccagcccatattttcttgactgttttctttttaccttaatttagaaataattattgttatgaatattctgttgcataatgtttgaggatgtttttagctatagtgggaatatgggaagttttgatagaggcgaagacattggcctgtagctgaatagcaggatcatggttatcatggagcctgtccagtcagagttttctctgtttttgcacttgtattcatctgggtagacttttgatattatttaaatttaggacacagcaagaaaaacaggatggaatttattttattttaccagtttttgcctataaaaatgaacttctggtacactcctataaacgtatatggtgttttactggatgcagttaaaaaatgaaagttaaagttgatgcttagagtgttttcagggtctttttaaagtaaaatttttatctttttcacttacaggtaaaaagctccgactcaccattattgaatgtgggtgtgacattaacatgatgattgatctggctgaagtagcagatctggtaagtcagcaggggcagcctggggtgctgatggagacttacagcattgtgataggttatttaccccgtgatgaagggaagagagttttatgattattaaaggaatcatggtcatcatcagggatacagtagatgtgattgaattgatgatgataataatagtaataaatattgttatattaataatacaaatggaatgtgcacaatgaaatgtattccaaaatctaaaagcaaatcacaggatagagaaaacctttaatgaacacagctaataagagctcattaacatgcatacatatatacgtacaaatatttcatagtaagtaccatttcttcttggacccttcctggcactgtgctaactactttctacaaacttagcttacataaactcttgatatacccttgaggtgagtaggtattatctgtagtttacataagatgaaatagagcctcccagcagttaagtaacttgtgtgaagatgggacccttgttcatgatggttctagaaccttcatcattaatgataatgctgaagtaagtacatgaattgcctgaagaagtggtcagagtttatcatagaaaatctagctagtactcagtgtgtggaaaatgtatacactcttgcatttatggaaatgataatgttcagtatttctgatattctattaactattttttaaattagcaaaaataaaatacaaattggcaaaaaaaaaaaaaagaaagtccgggcactgtggctcacagctgtaatcccagcactttagcagactgaagtggcggatcacctgaggtcaggagttcgagaccagcctgaccaacatggagaaaccctgtctctactaaaaatacaaaattagccaggcgaggtggcgcatgcctgtaatcccagctacttaggaggctgaggcaggagaattgcttgaacctgggaggcagagattgtggtgagccgagattccgctattgcactccagcctgggcaacaagagcaaaactccatcaaaaaaaaaaaaaaaaaagcaaaaaaaataagccttattgattaggaagtgtggggtgacagataccttatttttttcatttttatatatttttcgttttgttttgtttttattggagacggggtttcaccatgttggccaggctggtcttgaactcctgacctcaggtgatccgcctgcctcagcctcccaatgtgctgggattacaggcctgagccaccgcgcctggtcttttatctagttttttctagagctacagtttttatactttggcccaggaagacccataaaatataaagtgaaaagtaatacagattttaaagttgtgccattgtaatgtcagaaaactagataacctcaaattttgaatctataatgctattagtaaaaataagtgttattattaatataaagttgtgtataaatcttgtgtacttgaaatagttcatagaagtcatttgtttctcttttatttaaagtgtagcaagtttctaattttaaagacatacatgttaagagatgcctttacttttttatttttaattattatggatacataatagttatacatatttatattttatgtgtgtgatcatcaaatcagggtaattaggatatccatcacttcaaacattgatcatttccttgttttaggaacatttcaatttcattcttttagttattctgaattatataataaattatagtcaccctagtgtgctgttggacactagaatttattctaactgtatttttgtacctgttaacctttccctctttgtccctccctccctgctccccttcccagcctcttaaccatcattgagagagatgcctatgtaaatctttttaagattttcaaaaggagcacacacatttagtaaagcactctagctaatgcaggatacacacgatgtgcgttttcttattccttgctctaaccactggtctctcagatccctgcagagcagtatcctcctagatacatataaacccacatgccaccgtttaaaaacacaaatggtagcttattttacacactgttctatgctttgcttttttcgtgtaatatatcttgaaggtatataatcagtaagtactgtagctctgcctccttctttttaatataatattccattctgtggacgcaccataatttatttagcctagcttatgttgattgctctgctctgggttgtcaaagcctcctgagtacagcaaaagcacagacaatatgtggatttgggtgtgtatgtgtgtacatgtgtggattatgggagtaacactggcttcgatgacaaagattggcagctgagggactgtttgctccctgttcttcctgaccctacaaccagctgcttgtcccttggcactctgtggcatcagatgtggtgtgaggacattctacctgttctttgagctggtccagtgttgctggaaagctctgcttgctgccttggtccgcagtggcagctgtgctttcttacaagctgaccatatattctgtggtttcggattatggatgtttcctagtttaatcaaaggtgggcatttctgtttccattttttgttatttttagttatctatggaaagataggaacagaaatgtctttaatattaaacctagaagtttccaggaatcaattctgaaattattttgcatctttgaagtgtcttaaattacaaaaattggtcttatctgcttatattttcttatagagtaccattcatcataatcttactgttttttgacttaattctaaaccggtagctatttaaaataaaattctgagctactgagttatgcaaattaccatataagatagaggtgtacaccacatacttgccagcaaaaaacagattggttttttttttctatgaggagattgaaacaagaggttgattttctgtacatatttaatatatttcattgattatcactttcttcccattctttggatgtcagagacctattatttggcttaaaaataccttacagaaaacttcatttctttaaattagggtttcttaggtaagggccaggttagacccagccttttctgagttacttctcatgcattagaattcttacaatggatgtttatatcctagtggccttgtcttatggttgccttttagagcaagtcagagggtggtggtttctctgggtgatgcctgtgtagtcatttgatttagtctggagtgggacttttctgttgagggccaggtagtgaatattgttggttttgtggatcatatcttctgcagctacttagctctgcagttgtagtgcacaggcagccatagatgatatgtaaatgaattaatgtggctatgttccaataaaacttgagttacaaacacaggcgatgggctggatttggcccgtgggccagttgccaacccctagtgtaggtggtctgttttggtagtttcttcgagaaatgatgtgtcctgcttttaagtactgatgcttatagatgccagctttgggttcgaaatggaaacctttgagtttctcaacatcggtcaagtacgtggctttcctaaaattatgggagttctcactcacctcgactccttcaagtataataggcaactgaagaagacaagcaattaaaacacaggttctggacagaagtttacctggtaggaagagaaataattgttagatactaacagtataatcctttaaaaacagactaaagaggccaggcacagtggcacatgcccgtaatcccagcactttgggaagcagaggtgggcagatcacttgaggccaggagtttcgagctcagggcaatatggccaaaccccgtctatactaaaaatgcaaaaattagtcgggtgtggtggcggtgcatgtaatcccagctactctggaggctgagatgtgagaattacttgaacctgcgaggcagagggtgcagggagctgagattgtgccactgcactccagcctgggtgacagagtgagactccgtctcaaaaaacaaacaaacaaaaaactgaagagacattactaaacgtctctctaggatttgcctcctgaattccctttgtgtatgttttcccagtctctggaaagtttccctcaagagagtggttattctgggcctcttagtgtatctcatttgtctctgtacctgctgcaccaggcagtgtctggctgttttggggtcgggacttaatagagtacatcagaagtttctcccagttacaggacgaggcactgccccttcctttccatactgctgtggtccatcggccacagaaccgtttctgtgctcagaggcctcacctccctctcctcaccatacttagatggatgcccctgctcggctgcagagcagtctgcctctgtgtggttctaataagtcctaaaagaagccagcaaggctctggaagcctcaggacagtggctttgctggaagtctcccttcttaggattgcttcttgtttagagcttttattttgttgcagtattgacgagaatttaattgaaatttaatttttaattttcctttaatgtttaggttgccaagctgttctacctttctggaatggtgcatggagaatatcaagaccaagaaatccacaatctgggccattttattacagttatgaagtttaggcctctcacatggcagacgtctcatccttatatcctggcagacaggtaaaaagtgattgtaagcttttatttcctagaccatatatttcaaagctaaaaaggctagaaaaagaacagtgataggatttattttgtgcctatttgaatagtgggggtagaagtgtagttgatggaaaatgtctacttatatcattgctcaaagatgctgtgcctttgggagtaaattaattatgagatgtttaggaaaatgggaggacttggaagcatttaaagctacaggatatggccccatcctatgttcagcctcagttttcagtgatgctgccttcgtgcccgggtgcttgagtcctttatgtgtgccttcagtttccttcctttgtgctcttctttgtgctgtggttttctcagcctggaataccctttttccacctgccagaatccaagccacagtacaaatcccagagcacaggctcaccctcttccagaaagggattttctgaatatgttcttcactcttccctgaccccaggtggacgtcatctccctgtctggtgtcttacggaatgaatgtcactttcagcctagagacacagttgtgtgcctgccccttttcctctggtgggtggtgaatggtgcttccttatttctgtattttctagttttctaaacgacatgcttagtggacaagagtgtgatgagtcattgacacatgaaaggacgtataggaactttggcattcatttctgctgtatgattgagtttatttttctaggatggaagatttgaaaaacccagaggatatctgaacaaaatgtgactggcaggtgtcactttatggttatttaagaggagcacacttgaaaaataaaagccaaattcacatgccaggtattctcttgttgtagaacatactagaatcacacataggattcttgggatggcttcttttctcaggaaaactgaaaaatgaccaaacaagggaagatggctttggtggaggttttaaaagtaagccagctatgtgtaggcctgtaaaggtgttattgaatcccctcttctctgaccttttgtcttatagctagaggagcactgttccagtgtggcacaatactcttctttatggtcatgggttaagcccttggactgtgcatcgttttttttttgttttgttattggtgactgaccccatgagtcatgctctttacaaagcatgcatttggatgtttctttcttttttttattattatactttaagttctagggtacatgtgcacaatgtgcaggtttgttacatatgtatacatgtgccgtgttggtgtgctgcacctgtcaactcgagatttacattaaatatatctcccagtgctatccctccccactcccccaccccacgacaggcgctggtgtgtgatgttccccaaaaataaataaattaattaattaaataatagaaattctcggctgctttttatagctgtagaaaaaaaaatgaaatcttattttaaacttttctttttttttttttttttttgagacagagtctcactttgtctcccggcctggagtgcagtggcgcgaactcggctcactgcaagctccgcctcctgggttcaccccattctcctgtttcagcctcccgagtaactgggactacaggggcctgctaccacgcccggctaattttttgtatttttagtagagatggggtttcaccatgttaaccaggatggtctcgatctcctgacctcgtgatccgcccgcctccacctcccaaagtgctaggattacaggtgtgagccaccacgcccggcgaagctgacttttcccattatttttaacggtaattcataaaatccttgttaggtttgatgacaggtaccatattaagggcagcattttataacccatatcttaaacatcatctctggaagttgagagcctccaatgggttttctatagagtgcacatgataccacactcaggcagttcatggagtgtaagacatatcttagtgctttgtcatttgacattttaactgagaaaaaaatatactttgataagtttgacttacacttcccttccccttcaggtatctactgagcgtttcagtcaacaatacagctcgtgttcgacaatattccttgatggcagcacagccagccagcattatcttataatgacaataatatcgtgagtacaactatactgccgaggaacagattcctttattctaaaattatttcagccatttggttgtcctcttcagcaatcagtttgagaaattggagtcaaccatatattgatatccagattctcaatattaagtatcagtttctcttttaatcttagacgtcgtggtggaaggaaaaatcagttagcaaagaagcaatcccagaaacagtgtatctgtttgatgcctttatgcctttagacaatgttgaacacagtgagaaggataggttccctttattgaatgttttttgtgaaaacttagtttttcagtgcatcataggcctaaatcagtgtgcactactttggacattatccttgggagaaggaacagcttttcttcttctggcaccacagtgtatctgcatttgaatttctcccattgtgcatgagcacctcatgggccacaaagatgtgctttgagagcaccctgagatgaagtttattttaaaaggaacaataaccaacaccaccaccagctccacaggggctgtccagtgtacattattctcatctccttgggttattagtcttgatttttagaacacagtttggaaagtgctaatttagaatattaatgtctttatctctaatttaacttttcattctgtaaacataactagcttataaacaattttgtttcaaatgcactagcctttttagctaattcaattgtcaataacttttacttcaattaaaagtggcaagtttacactcataataatgtcactttcctccctcccttttaacaatagttgagaggaaattgtgtttcgaacaaaaactggactcaaactctgtctcaagtcctgagctttgggacctattgagtaatcactaaatgtctgtagtcagccaagtctcttaaatctttgagcacacatacacaaaaattactttgactagagtccctggcttcttctgagttccaaagattttgatatgttagcacataattcaaaagcagctttgaagattaattttgctgaaacaaatttcgtgcttttttcctaattattctactttttagaagtctacttttgagagtatagtaagttttaatttgccaccagcgagtttgagaaataatcatttggtgtattcactattggtgaaataaagttattgaacaaattaatagggcaaattggcttcaagaagatattttgaaaaatgttttatcatgaatcagtagtgcactgttgtcagtgggataggtggaactcactgagatcacttatgcaaggttttttcaaaatacaagtctgcaaacacatgtatcttcccatctccactttccctctatctctaggcactgagaagccttttaggaaaatcaggatggatgtgaggcatctttctgtgaagaaaagcatcccagaagattctgattttcaccacagctcaatcattccaaactttgctgctgattgaaatcacctgggaaacgtttaccaagaaccttgatgcccaaagccatacccaatactaattaaattaaaatgtctcatgttgaagatgaggcagatattaaagcttctcaggcgattttaatgtgcagcgaagtttgagagccactgcttaatttgagtttaggacgagaaactgctcctatttggtgggaccttgggcaagtcagttttaaggtttgtttccctgatctgtaaaacgagtgttgaattaaatgtcacataaggtcactggtcctttccagcatgtaactttaaattctgtgattttaaaattatttcagagatgaaaactacttgaagcactatagacatatccatcttacatgctaatgttacaggctttttaaaaagtgctaatattgtgtagacctattagtagaattgagatttgccttccctcagttgttttgagcctcactctacaaaattagctgggcgtggtggcacatgcctgtaatcccagccacttgggaggctgaggcaggagaatctcttgaacccgggaggcagaggttgtggtgagccgagatcacaccattgcactccagcctgggcaacaagagcgaaactccatccacacccccccgccaaaaaaaaaaattatctggacatagtggcgcaaacttgtagtcccagcttcttgggaggctgaggcatgagaatcgcttgaacctgtgtggtggaggttgtgaggagtcaagatggcatcactgcagtccagtctgagcaagagagacagactctgggtcaaaaaataaataaatacataaaataaatcgcatgggacgaaaggtttcgtgggtagaaaagcatataacagggaaatctgttattatttatatattgtaatcaccaacagaaacgcatcttctaacagcattttccttgcattttggttctcatatttttgtaaaaaacaaagaaatgaaaacaaagtgcgcttatggtactgttctgaactagaagatttgaatttcagggccgctaggagagtttcctctgccccccttttaaaaaatgtcttcaggcctaacaaatgataacatctattgttatgaattttttttccttccacagtgtgaccttggagatacatcatcatatcacggaaaggtgagctttttagaaacctgtcttgttattctagctaattactttgcaagatatcaagctcagtgttaggtcacagctctagacatcataagctgtattgtgtctactaaaatatcgaagcaaattatttgtattttctttgttccttaagactctcataattcttaaatgattgagaatctcaaagagtatgtgtttatattgattatattgatatttagtgtggtagaattatacatttgaaagtttttcaaaatctatttttagtttagatttcacagccttaccactgttgatattatgtgctagataatgctttgttgtgaggactgtcttgtgcattgcagagagtttagcagtattcatggcctctaccaactagatgtcagtagtaacccatgacccaggttataacaacagaaaatattccttgagaacagtattgttaacagaaatttttcattgaaaaataacttttctacaacaaaaagttgagtaaaaagtgtgtcatgtatttatattatttaaagtctctcatgttgagcttaataggagacaaatggattctctagagctttatttgcaatttgctttaaagaagcaataagaggctgggcacggtggctcatgcctgtaatcccagcactttgggaggctgaggcgggtggatcacaaggtcaggagatcgagaccatcctggctaacacggcgaaaccccgtctctactaaaaatacaaaaacttagctgggcgtggtgacacgcacctgtagtcccacctattctggaggctgagttaggagaaccacttgaacttgggaggcggaggttgcagagagctgagatcgtgccattgcactgcagcctgggtgacagagcaagactctgtctaaacaaacaaacaaaaaaagcaataagctggtggggcgcagtggttcacacctgtaatcccagcattttgggaggctgaggtgggtggatcacttgaggtcaggagtttgagaccagcccgaccaacatggtaaaaccagcctctactgaaagtacaaaaaatggctgggcatggtggtgcacgcctgtagtcccagttacttgggaggctgaggcaggagaatcgcttgagcctgggaggtggaggttgcagtgagccgagatctcgccattgcaccgcagcctgggtgacagagagagactgtgtctcaaaaaaagaaaaaaagaagcaataagatgacctaacctcatgcaaatatgtagttggtagaaggtgtatttttaaagttttcagacagttgtgggtatttgttaacactaaatcaaaacttcacaagtggtggtttcttaaattagttacggtggcattttacatattaataaatttattccatcagtactcattgatctttcttgcacagtaaatggatcttttgctccatacttgcatttataatatcatgcattagttacttggaatatattggtttatgttttattgtgtcaaaaatcacttttagtttaaccaccaatcttagtttaacacgcctttaagtattgaaaagctgccaagcctacagtagaaggaagaagtttttcaaagtccacaggaaagcttaaattttatcattgggaacaaatacgtatttcccttgaagtgacaacctctcacttcatttatttttgagaatgatagttgaactggttttttagaccaagtttcactctgtcacttggctggagtgcattggcatgatctcagctcaagcaatcctctcacctcaggctcctgtgtagctgggaccaccggtgtgtggcaccacaccaggctaattttcttatatgtttgatagagacagggtttcgttatgttgcctaggctggtctcgaactcctgaaggagctcaagccatctgcctgctttggcctctcaaagtgctgggattttacaggcatgagccactgcactggcccagttgtacttttaaataaaaatgatgttctgtgaaaaaagtgatttttcagttcacagttaaatcatggattctttaaaaacaaaaaaaaaagcgcttctcgttaactttccacttattcagaatattagagacatgtcaagatttaacaacattaatttttactgcttcatcaaagacattcttaagaaattcaggctatgttttttacctgtaggggacagtgaagaatagaaagactactaatgtaattggtaccactgccttgatttatgctgagaaaccagccattgtacccacttttgcttttatacaatcatggcaagtgtcaataaaaaagcaggcaatgactttgtattactttcacaaatttttaaaatttttcatcagctttctcaggtttaattagtatgattcagaacagtgttggccaggcacagtggctcaggcctgtaatcccagcactttgggaggccgaggcaagcggatcacctgaggttaggagttcaagaccagcctggccaacatggtgaaaccacatctctactaaaaatacaaaaattagccaggagtggtggcaggtgcctgtaatccctgctacttgggaggctggggtaggagaatcacttgaacctgggaggtgaaggttgctgtgagccaagatcacaccattgcactccagtctgggcaacaagaataaaacttgttttttttttttaaaaaaaagaacagttatgagctcttaggccttctggaaggggtcttcaggatcctgagaggtccacagagcacatttggagaaccactggtttatacacagacacaatgcattagttttacaaagtttaaagttcatcaaagactggcctcttaaaaaggcagatgagtttgtcattcaaacaacagaaaatacataaatacatcatgagagtatactacagagaactaaagagaaaggaagctaggaaatctgaatcacatttacatttattaaagtttactactactgctttgtagaacattcttgtgtttcaatgtgtggttagaagagtgaaaatatatttggcttattgccatggcctgttagggagagtcaatactcatgggcatttctgactggttatcatataaaagacttcacggtacaggccatgatgtgctgagaaagaagaagtcaggaaaccctctgcaagtcaggatccaggagaagaattcgtaaaaactgctttggtaaagtaaacaccaaagcacacaggaggcagtattttactaaacaaatattatactaagatattaacagtttttgaagtaatgcgctttcttattttttagagatgcagatagatctttgaccatacttgatgaacagttatactcatttgcggtaagtggcacttttattgaggttgtattttcatcgtacacttgtatctgtttcatgctgaagtcaaagccatctttttttaaatcttccccatttcatgttgcatttagtcatcttaagtgttgtaaaaagaatgtgctggagtaagaactgatctgcggctctgtttagttagtgagctagtatgagtaaatatactatccaaacaacagaaaatgtatcttttttttttttttttttttgatggactctctttctgtagcccaggctggagtgcaatcgtgcgatcttggctcactgcaggctctgcctcccaggtccctgttcaagcaattctcctgcctcagcctcccgagtaactggaattacaggcatgtgccaccatgcccagctaatttttttttcttttttctttctttttttttttttttagtaaagacagggtttcaccatgttggccaggatggtcttgaactcctgacctcgtgatccacccaccttggcctcccaaagtgctgggattacaggtgtgagccaccatgcctggcccagaaaatgtatctttttaaaaggtaattgtgagctgtctataggaccctgcaagccactacccaatttttgaagccattcttcttctgttccacacagttttccaccgtgcacattacgaagaaaagaaatggaggtgggagtttaaataactattcctcctccattccattgactcccagcaccagccaggaggacctttatttcagtgttcctcccactgccaacacacccacgcccatttgcaagcagtccatgggctggtccaacctgtttacatctgagaaagggagtgacccagacaaagggaggaaagccctggagagtcacgctgacaccatcgggagcggcagagccatccccattaaacagggcatgctcttaaagcgaagtgggaaatggctgaagacatggaaaaagaaatatgtcaccctgtgttccaatggcgtgctcacctattattcaagcttaggtgattatatgaagaatattcataaaaaagagattgaccttcggacatctaccatcaaagtcccaggaaagtggccatccctagccacatcggcctgcgcacccatctccagctctaaaagcaatggcctatccaaggacatggaagctctgcatatgtcagccaattcagacatcgggctgggtgactccatatgcttcagccccagtatctccagcaccaccagccccaagctcaacctgcccccctcccctcatgccaataaaaagaaacacctaaagaagaaaagcaccaacaacttaaaagatgatggcctgtccagcactgctgaggaagaagaagaaaagtttatgattgtgtccgtcactggccaaacgtgccactttaaagccacgacgtatgaggagcgggatgcctgggtccaagccatccagagccagatcctggccagcctgcagtcatgcgagagcagtaaaagcaagtcccagctgaccagccagagtgaggccatggccctgcagtcgatccaaaacatgcgtgggaactcccactgcgtggactgtgagacccagaatcctaagtgggccagtttgaacttgggagtcctcatgtgtattgaatgttcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacgaaaccctcaatagagtcaacgagggaagagaaggaacggtggatccgttccaaatatgagcataagctctttctggccccactaccctgcactgagctgtccctgggccagcacctgctgcgggccaccgctgatgaggacctgcggacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgtaaaaacaaaatgggaaaaataaggataactcagaatttcaaaaggaaatcacaaattcagctaataatagcattttcagtacttttcgtaaactaagtaaatacacaaaatgttgatttttctgaccataagacatattttatgtccttttgccgaggtgggtgtgttagtctcaggccctcctggccacattgcccaagtcacacaggcttctgtattatgtatttagataagatgtgtgaaaatatatttgaaaaaaagttcataaatatgcattgatttttgtacatatggcacctctttttcatttttatttttattttttttggacgatgttttgctctgtcgccccagctggagtgcagtggcatgatatctgctcactgcaagctctgcctcccagattcacaccattctcctgcctcagcctctcaggtagctgggactacaggtgcctgccaccacacctggctaattgttttgtatttttagtagagacgtggtttcaccatgttagccaggatggtctcgaactcctgacctcgtgatccacctgcctcagcctcccaaagtgctgggattacaggcgtgagccaccgtgcccggcccatggcacctctcttaatttataaattgaactggatgtgaactaataatgtcagctagttgagataagagggttacagatctgggcgcagtggctcacacctgtaatcctagcactttgggaggcctaggcggactgatcaccaggtcaggagatcgagaccatcctggctaacatcatgaaaccccatctctactaaaaaatacaaaaaattagctgggcatggccgggcgtggtggctcacacctgtaatcccagcacattgggaggccgaggcaggcagatcacgaggtcaggagatcaagaccatcctggctaacatggtgaaaccccgtctctactaaaaatacaaaaaaaaaaaattagccaggtgtggtggcaggcacctatagtcccagctattcgggaggctgaggcaggagaatggcgtgaacccaggaggcggagcttgcaatgagctgagattgcagcactgcactccagcctgggcgatcaagcgagactccatctcaaaaaaaaaaaaaaaattagctgggcatggtggcaggcacctgtagtcccagctacttgggaggctgaggcaggagaatggcatgaactcaggaggcaaagcttgcagtgagcagagattgtgccactgcactccagcctgggcaacagagcgagactcggtctcaaaaaaaaaagaaaagaaaaggagggttacagatcattgcacatggaaaatatttccagcagtaaacactcccattaatgtgatctacagcttttaaaaaggagcatctcagaataagatggtggtacaatttgcttattgagaaaggaaaaaaaaaaacacacgagtatattacaaggggaaaagaaggaatgtgatttctcatgattgaaagcttgatttagattgcatacagcttttgctacccaagaccaagcagctctggcaagacagggtggttttccaaatgccagaccgaggtgccttatgaaggcagctgccgatggttccagatgtagagagataggtgatgcaggagggaaagctggattggaaaagggagagttttgtagacgggctacactcattgtggctttgaaagagcagagccggcagcctctagtcatcatttggatatacaggactagagcatgaatctgatgtagagctacagaatgaagagcaacagcagctgtttaaataccgagaaagtgtgtagaatgaaattggacaagccaagcatggtggtttcatgcctttagtcctagctacttcggaggctgaggtgggggaattgcttgagctcagcagtttgagtccagcctgggccagatggtgagaccctgtatcttaagaaaagaaaaaataagaccaggtacagtatctcatgcctgtaatcccagcactttgggaggccaagttgagaggactgcttgagtgtaggagttcaagaccagactgggcaataaagcgagacccatttctaccaaaaaaaaaatcaagaaattagctggacatggtggcacatgcctgtggccccagttacgtggcatggcaggctgaggcaggaagatcacttgagcccaggaggtggaggctgcagtgacccatattcatgccactgcactccagcctgggcaacagagtgagaccctctctcaaaaacagataaagtggacagaaaataggtcggtaaggactaatcatttaaggcacaagtccccagaagagtggctactagagtgggaggaggaaaagcagaaggagaaagagttgaagataggcgaggctgtggtcccagtgctgaattctgccaagcagtgacttgattcatgaacactcactggatgctgaccctgttgctcttctgagtgctggggtagaggggaggagaggtggagcacagttcttgcttttatgagcttatgttctaggaagttcaagtattttttcaggtagtatgaaatagcaggaagaggaagcaggctaaagggacacagagtgattgggggctattttaagtagaatgataaggaagagcctgtctagagagctatttgaacagtgacctgactgaagggacaacagaaagcagtgctgacattacaggtagcaggatgactgccaagacagaaacgcatttcatatgtgtttgaggaacaagcagcaaggtgaccagcatggggagagtggagaatgagggaaaccttgaatgagaataaagcaattccatcttggaggctaatctgccatattctgattaatcccagttccaagaattcatctacgatttctattttatctttttaaaaaattattttttattttttattttttgagactgagtctcactctgtctcccaggttggactgcagtggcacaatctcagctcactgcaaacttcacctcctgggttcaagcgattctcctgcctcagcttcccgagtaactgggattacaggcgcctgccaccacgcctggctaatttttgtatttttagtagagacgaggttttaccgtgttggccaggctggtctggaactcctgacctcaggtgatccgcccaccttggcctcccaaagagctgggattgcaggcgtgagccaccgtgtctggccatacacatccctgccgaagcccgcattacccttcccctatgctatagaagccctgggtcgggggggtgggggtaatggcacagggatccaccatcttatcttggtgtcatccctgacttggcttctgttcataaacgcctattaaatgtttctttctgagaaactggatttgtcagcctctttctttggtatctcaggttccttggtctttgcgggtaggtttatatagacctgctcagcacaggacaggcagtttctcaaaaaattaaaaatagaattaccaaatgatccagcaatatcacttctgggtatatagccaaaataattgaaagcaaggtctcatagaaatgtttgtacactgatattgatagcagtggtattcacactcatcaaaagatggatgcagcctaattgtccataggcagatgaattgataaaatgtggtatatacatacaataaaatattcttcagccttaaaaaggaaggaaattctaacacatgctacaacatggatgaacattgaggacgttatgctaagtgaaacaagccagttagaaaaagacaaatactgtgttctttcacttatgtgaagcgtctagactgagtaagcaaactaatagaaacagaaagtagaacgggggttgccagggacatggggaagggagaaaatgggaagttgcttagtggatatagagttttggttttgtcagatgaaaaagttctggagattggttgcatggcaatgtgaatatactctacattacccaacccaagggctctccttgacccctgttccaactaccacttagaagtggttaaggtagtaaattttatgtatattttaccacaattcaaaatagaattattattttttttattataattttttgagatccctcactctgttgcccaggctggagtgcaatggcgccgtctcggctcactgcaacctctgccttctgggttcaagcgattctcctgcctcagcctcccaagtagctggaacttacaggcacatgccaccatgcccaactaatttttgtatgtttagtagagacggggtttcaccatgttcgccaggctggtcttgaactcctgacttcaggtgatccacctgccttggcctcccaaagtgctgggattacaggtgtgagccaccatgcccggctgtcaaaataggtgttttttgttttgttttgttttgttttgagatggaggtttgcttttgttggccaggctggagtgcaatggcaggatctcggctcacggcaacctccacctcccatgttcaagcaattctactgcctcagcctcccgagtagctgggattacaggcatgcaccaccatgcccagctaattttgtattttattttagtatagatggggtttctccatgttggtcaggctggtctccaactcctgacctcaggtgatccacccaccttggcctcccaaagtgctgggattacaggtgtgagccattgcgcctggcccttttttttttttttttttttttgtgatggacttttgctcttgttatccaggctggagtgcaatggcacgatctcagctcactgcagcctctcctcccaggttcaagcgattctctttcctcagcctcctgagtagctgggattacaggcatgcaccaccatgcctggctaattttgtatttttagtaggtatggggtttctccatgttgatcaagctggttttgaactcctgacctcaggtgatccacccaccccggcttcccaaagtgctaggattacaggcgtgagccactgcgcctggcctgaaaaaaaattttaaagtttgagaaaatacaaaattttcatagtctccaagtatttctcctaagatctttccccctatgagggggaaagatagtaactttacaatggagaaacccagcagaaacctgaaccaaatgaacaagttcaacatcatcagtaagaaaaactatcaatgccataactctgatggaatgcactgggaaggattccacatcatttttgagctgtaattgccaaaagtgcgtaacttcagtccaatcatggaaatacatcagacaaacccaaatcgaagaacatttgacaaatagtgatcagtactggttcaaaatgtcacggttatgaaagataaggaaagattgaggaactgttattgcagtcctacaaaacggcgagagactaagaaataactaaatgcagcgtgatcctgggtggaatttgggaacagaaaaaggacattagtggaaaaagtggtgaaactccaataaggtcttttgtttagcgaatatgttcattttaaattagttaaattatttaaatatatttaaacattatttaaatgtatttaattaaattaataaaattggttattttgtgaaataattttaatatagttaaatatgcgaatgtggatttcctggttctgatcaccgtactgtggctaagaggtgaatgttcagggaggctgggggaggaataaatggaaattatactattaagttggaagagagaaacctaccccatcagtcacgaaaccctcacattcatggcagtgtgtcggaggttccagtatgaatggcatttcccagatgtcagcgcgaggtcctgtggagggagtggggctccctgggaatctagtggagagcattcaggtctcccttcctcaggagcctgcccttcctgcacagaagcgtcagcctcacctctgtaccactgcccctctgcctctcagaacccacttggcttcaggaagattctactgccagcctcctttcccggatacagcctccggggactcagccttgccttctcaagtgctccagcctctcttgggaaggagtgctctcagataccacaccgctggacttccccgggcaccacctgctccttcttcacttctccagctctgcattctcactctgagggtcctctcctgctgggagtgtgtgttgctggcaacagtgaagatttcccccctgggttgccccccatgccctgttcttctgcacttccctggcttcctgcgttggttctgctggtgtctcctgcttttgggtttacgtggcttcccagcttcctaatttctctgaagttgagtttgatgtgtgtgttgatgatgggctttttcctgctcctcctccttctcttcctcctcctcctcctcctcctcctcagtcttgttgttgctccatatagtttccagaaggagaaaagggacactgtaaaattaagctgctgcaggctgggcacagtggctcatgcctgtaatcccagccctttgggaggccgaggcaggcggatcacctgaggtcaggagttcaagaccaacctggtcaacatggtgaaaccccatctctaccaaaaatacaaaacttagcaaggcgttggtggcatgtgccggtaatcccagctactcgggaggctgaggcaggaggatctcttgaacgcaggaggcagaagttgcagtgagccgagatcatgctactgcacttcagcctggggaacaagagcgaaactccatctcgaaataataataataataataataataataataataataataataataatgccatgtttctatcagacccagaaatcccgcagagtgagctggaattctgtttctctgtttcccctccatacccactggctcctctctgcccactccctcttggactgcatcaccagggtgcctcactgtctggccctagtggaattcaaacagtggaggatgtcataggaggtgggagagagagaggagaggtggttattcgctcagattcttccttgctggtttggcagtggccacatctttctactgatggctgcagctcctgatgatcctcctctacctccacagctctctttgggatctgtggacacctttcctgtccctctagacccagggagataacagctcccactcttgctggtccaggacattcctcatctcttactggttcccttaactcggtccacacttctgtgaacagcccctttcctcaaatacccattccaatatgtcctctggcttccaccaggagcctgactgatacccacaggtgggtgaatgctggcatgctgctgggcccctcttcctctggtgactggccagccaagtctccaggagtctcgttagggtgggcaggtggtgggcacagcacaaactgtgagctcaaatccacagagcaaaagtgggagaagacactggcaggatggaccgccacaaaactcttggcattcgtgacgtctgtcctttaaatcacgcaaggcatcatcatgcttcagacatgagacagcctaagtatttaagtatttcaaataaacaaattgtttttcagaattggtcattgctaagttggcaaattgctattggaaacgttggctgtccttgactcaatgattcagccagctagtcccttgccaaactagtttgttgggcaaattccaccttgagaatttatctgctcctgtcaaagccagattctccctgcctgaggggaggctggacttgaccttctgactcaggatatgctgacttgggtccctaggtccaagggcggccctcttgggcccaccgtgggctggacctcttccatgatggggtggtggagggcaggccccacctgattcacccttgacctcatccaggcaggtgaagttccctgcaggagtcacctgagcccagcccctcagaccaggatccatcctgtttaggaggatttggggccatctcatgttctttggctagaaaggggtcccactcttaggggtctgccctctgtggggcacagatggcttgctggggcccatggactgggctgggtggatgggaatctggtcacagcagcagcggctggaaggccaagagggagggcaccagggcctgggacccatgtcttgtcctgggcctccccgggcctcttgccttctccccagcaggcatttgggatctgtgtctggacccagccttgcccagaaggccatggtgtgttgtcattagaatcacagtgctcacaccaaggcagtgcattaaattagcagggcagggtctcatgggcaggggaccatgtggagggggtgggggaaggacagttgtcccccgaggctgcggtgggcctggctctggtctgggcagtgggccagggtcctgctgtgtggctgagctctgacaacaggctgtctgagtctggtgagctcctgaaagcggggactggtggagagtaccctagggtgggagctcgtgaggagggggtctgtggggtctggaagccattctagagcaggcagatgacatttatcagcggaacaggcatagaaaggacccttgtgcgagtgggggacacacagcctcagaagaaacagggaaggggctttgacaggtccagggagaatccctgaggtttcctagaacaattcccaccagccatgtcccaggtgtccccccatcccccaggcctctgcagtgccagcccaatgccctgggcaaaaacatcctggactctggctgttacaaaaggaggacagggtcatctggacccgcctgagctccaggcccccgactttcacagccccttctgggtccagaagttcatacgtatataaatgaaaaatgtgcaagaatcatattattgtattctttttcataaagagggcccctctaaattgtttaagccccaattcacccctgcccaaaggagatagcaatggcatgtgtggggccgtagtcttgagacccagaggtcctgctgcccacgatacccactgtccaccctagggggactggccgtagccctggagcccgcaaacaccatgcaggaatgcaagagggtctcagctcccgagtcccaggctgggagggcccacagtccagtaaactaatcaggccccaacacacccaggagagcagctccaggagcctgcattgaagagagagcctcagacccctgccacaggcctgcaccccagaagtaggaggatgggaagacctctccttggctcctggccagcggaagtcacattccccagccctctggctccaaggcagcctcacgtcccagtcactccttggcccaccctaccggttggtcagagctcactgccaaagggcacctcaatgatgagtggagggaacaggtgtttaccaggagcttgcatgctttgtctcagggacgattagtgacacagccaggaaggcacgctatccccattttacagatgaggaaacggaggctcaggttgggctggtgactaagggaagcagcatgtggcaggtggcttgaggcatgtctgtccatcatgagtaactagggagcagccctgccactcctcatgtgatgcaccaggagccagggaagctgctttctaggggattctagctaaggccagaagcatctccctgagtggtggtggaggcctctgtctactcctccaggactgccaggggataggagggcactgctggcctcacagacactcttgggtgagtgagcatcagctgagcaaagccaggtgactacacttctgcccagtgctgtgcccccctctgactcaggcaaggcaccaccctgaacgccccaccctgtcccatagaggccacaaactgctctgcagagccagggtctccaggaatggggagggcagtcaccctcactccacttgtgttcatgacccaaaggactgcccaggtctccaggcccatagaacccctaaacctcttactaggccacactggggaccttgagcagcaggcttggaatcctaggccttgtctccaggtacatatcagtacccaggcttgggaagttttggtctcggggggctggcactcaggccctctgcctcaaggaagaggcatgtccagatctctcctgtccagccctgctccctgcccctatccttcacggggtccctaggacagggttacagaagcctcaggctgtcaggggatgctgccaccccagtgccagggtggctccgcccagccccttcctgctgccgccctcgctgactcacctgtccagcctcctactgggctggggcaagggcttgttgccccagagcctagacaggcaccagaggcagctataaaagcatgttgggccagtcctcagcatcctagttcaccactgtctgctgccacacgatgctgggaggcctggggaagctggctgccgaaggcctggcccaccgcaccgagaaggccaccgagggagccagtgaggacctggggctcctttctacctgggctggggggatctggggcagactgggtctgtgggaggcggatctaagtaggcaggtgaggacctgggaggaggccttggcccctcaggaaccctggtcccctgctctaccaagtcagcacggagttgaggggtgcagacctggggaggtctcctgggggcagggcatgagtcctggtgctgggtgaacactggcagcttggacccttccctctggaaatctggggagcctttcttgtcaaaacagcctattctgaataacctatgcaggaaaaggaagatggatttttatttttaccataactttaaagcttcaaagatttctaaacaagtcaccaagtctgttcaaagtcaaaaagggcattttcaatttcatccaagtcccctgaagcatgtttatttttatttttatttgtatttgaaatggagtcttgctctggcacccaggctggagtgtagtggtgcgatctcggctcactgtaacctctgcctcctgggttcaaagtgattctcatgccttagcctcctgagtgtctgggattacaggcacccaccaccatgcccaactaatttttatatttttagcagagacagggtttcgccatgttggccaggctggtctcaaactcctgacctcaagtgatccattcctcttggcctcccaaagtgctgggattgcaggcgtgaaccaccgcacctggtcccgaagtgtatgttgtattcagaggtcagcagctatgtgtggggaggcccagccaggagccactcatgggtcatcgtgtgaaaaacagtcttgcctgagtttgtgtcctctttctaaatggcagcagacgcgtattttgtttttgactctgcagctggtgtggaccacctgctttaacctttcactagcctctgagttttgtatgattcctgttgggagaaaagctgagtgttgggagagaagctgaggcagggcttgctagattggctggctccttgcttctagcactcccattttctcaagtagccgtatgtttctcattcacttgatacaccgtttcctttcaaccgccacatcctcaccacctgtttctttgttagatcaccaataaatagcatgggttcccagaactccgggccttcgcagcctccacactcgcgatggcgccccgctcccattttctctctcaaactgtctctttctcattcctttgactcctctggacttgccgcccccgcgacctggtgttgggtctcatcaccccaacagattcccattctaaagatgagggaaccaagaggtggaaggtagagttagaataagaaccatttcttctgactctgaaatccttcagttctagcatgctaccacctacactttaaaaaactctgaagtaggcagagaattcccttttgttggaggaattgctttgagagacctggttttactggatgaggctttggaaaccaacctgaggcaggcgctagcacatcctgagaggggtgtgacctggcacagaggcccagcctgggcttcatgtctcagctggcaagatggcctgctcattgccattccaggccgggcagggccaaggggcttcagggacccatgccctcatggggctcactgagctcgtctcccggcagccaaggccctggcgtctccgaaggaagccagctgtgggggaaggtccttctcatgagccagtctgtcctggctgggggtggcatcccagagccccatctaggatgtccagggatgtataggtccattgtgaggataagccagcactgagccctcaccctggactgggagggcagtgggcctgctctgagccctcaccctggactgggagggcagcggctctgctctgagccctcaccctggacttgtctcctctgttcagttcatgccgtggaagaagtggtgaaggaggtggtgggacacgccaaggagactggagagaaaggtacagctggctgaggtcgggcagggaaggagggagggagcaagggaagctaggtgctgggccaacctgttctttgactaaccaggtcaaactctgcccccaatgttgcagcctttcagagcctcttggctggggcagttatctatgctcatcagaggccacagactgtactgcgttagggcactgtctagatggttctgtctgtggaataagaagacaaagtcacacaagactatgtgacagcacactgggacaaaacatttaacatggcagggcgcggtggctcacgcctgtaatcccagccctttgggaggctgaggagggtggatcacgaggtcaggagattgagaccatcctggctaacacggtgaaatcccatctctactaaaaatacataaaaattagccgggcatggtggtgggtgcctatagtcccagctacttgggaggctgaggcaggagaatggtgtgtacctgggaggcagagcttgcagtgagcctagatcatgccactgcactccagcctgggctacagagtgagactcggtctcaaaaaaaaaaaaagaaaaaaaaaattgctgggtgtggtggctcacgcctgtgatcccagcactttgggagcctgaggtgggcggatcacgaggtcaggagatccagaccacggtgaaaccccatctctactaaaaatacaaaaaattagctgggcacggtggcgggtgcctgtagtcctagctactcgggaggctgaggcaggagaatggcgtgaacccggaaggcggagcttgcagtgagccgagatcgtgccactgcactccagcctgggcgacagtgtgatactccgtctcaaaaaaaaaaaaaaatttaacatgtaaaattctatgttaaatgttaaattgatgtgtgtgagctatgagtagaactatgtacaaagcatatgtatatctcattccttttcaacaaaatagattccaggtagatgaaggacttaaatttacataaatgaatttattaacttactaggagataaccatcttagctcaggctgctattataaaataccataggccaggtgcagtggctcacgcctgtaatcctagcccttcgggaggccaaggtgggtgggccacctgaggtcaggagttcaagaccagcctgaccaatatggtgaaaccccgttgctactaaaaatacgaaaaccagctgggcgtggtggcacatgcctgtaatcccagctacttaggagtctgaggcaggatactcccttgaacctgggaggcggaggttgcagtgagctgagattgcaccactgcaccccagccttggtgacagagcaagactctgtctcaaaaacaaaaacaaaccataaactgggcgacttagaaacaacagaaatttctcacactcctggaggatgggaagtccaagatcaaggaaggcactggcagatttggcatctggtgagggagtctttctggttcgtggatgggcccagctctgtcctcacatggtggaaggagctagctctctgtggtctcttttatgtgggtgctaatttcaacctcccaaaggccccacctcttaatatcattacattaagactgaggatttcaacgtatgagttttgagggggaagacatcataaacatttagacatagtaataacataaaagactttggcctaatcttggagaggggagaatctttagaaccatgacaaaaaaatcagcgccataaaggaaatattaagtaaatttgacaatccaaaactgaaattttctatagccaaaaaaaaaaaaactataaaccaagccaaaagaaaaattacacactgatgaaaaatatttgtcataaaaatgataatccaatataacaacccaatataaaaatggtcaaaagacataagcaggcattttccagaaaaaaggataagcaggcaatgtacccatgagtagatgctcagtctcactcacagttgaagaaatgcaagttgttggggaaattaaaaccaaattcaaattcattctgcagtaatcctgctgcccttggtcccatcgggccactccagagactaatccattaagatggccacatcccacaggccactcaaggggacacaagttcagcgggtggatcactaggacattcttcctctttctttccaacagccattgctgaagccataaagaaagcccaagagtcaggggacaaaaagatgaaggaaatcactgagacagtgaccaacacagtcacaaatgccatcacccatgcagcagagagtctggacaaacttggacagtgagtgcacctgctaccacggcccttccccagtctcaataaaaagccatgacatgtgtacattgagcgctggatttatacccatttggatggaaacactaggcaaagtattttcttgttgatataacatattttacatatttatggagtacatttaagtatttattacatgcacagaatagtgatcaatcagggtgtttggggtgtctatcaccttgaatatttggtattactatgtgttgggtacatttcaagtcccttcttctagctactttgtttttttgtttttgtttttgtttttgttttgagacagagtcttgctctgtcgcccaggctggagggcaatggtgtgatctcggctcactgcaacctctgcctcccaggttcaagcaattctcctgcctcagcctcccgagtagcttggactacaagcgcaggccaccacgtccggctaatttttattatttttatttttttatttttttaatttttagtagagatggggtttcaccatgttagccaggctggtctcgaactcctgacctcaggtgatctgcctgcctgggcctcccaaaatgcccagggattataggcatgagatactgtacctagccttctagctactttgaaatatacaatacattgctgctaactatagtcaccctaggtgaagtatttttcaacagaaacactttgcatgtcccccgtgtctcctctgttgaggtggacactggcactggggcccctgctgctggctggataggtcctcatgatgaatcagatgcttctctgtcatgctaagtaagatctttcatgtcaggaaggggctcttctggaagaatagttagtgtctgtgctacatttcctaaaaaactgtttccccggaaactatatgtaactttcaggtgcctcagtgcttcaagacatgctaagggaggaccctcatttgtcttgcatgtttttgggatttttcttgagatgtttttgcaggactcagggcagataacagaccagcttgatgaagaatttagcaaggaaggcccccactgagctgcttcctgttctcgcagagatcagataagcatttctgctggagagttacagaatctggtcaaggagagactgagtcactgctcagtcatcctagaagctgctgttgatttttttttttttaagacggagtttcactctgttgcccaggcagaagtgcagtggcacggtcttggctcactgcaacctctgcctactgggttcaaacaattctcctgcctcagcctccccagtagctgggactacaggtgcccgccaccactcctggctaattttttgtatttttagtagagacggggtttcaccatgttagccaggatggtctcgatctcctgacctcatgatccacctgtcttggcttcccaaagtgctgggattacaggcgtgagcaaccgtgcccagcccagaatatttagcgactgatgtcaggcctaagtgttgatagtgggtattagtgggcaagatgcctggccttctctctttcttctcatgagcaagtcagtatcatagaggttaaacatatctttaagtagcatttaacttaacatttttttaattaaaaaaaagagaagtaatttgtaaaaatattgcatcccctatttctcttgctggaagctatttgttcttagcagaaatgagaagaaaaggtgttttgcttaaaaaataagtgagctgctcaccctttttctggatctcatctagaagtggcctcacagtttgtgaacagcccaggaatagccaatgtcttagctttggaatgtttgccactttccagctacagtggaccttgtatcctggtttggttcctgatgactttcaaattctcctgatccaaacgcaagctcagaggcatcagcacattgttggtggcagtacagactgaaacaccctttttggatggcggttcctctcacaggactttattcgccaggtgtgcacaggcacacacaggtgcccaaaggataaacacacagatctactgtagcatatttgtattactgagagattagaaacatcctaaaatgttaaccaaatcacttggatgaaaagttttgctctgcttattaggtttggcatacaatatggaggtgacatctattacttccagtgtattatagagtttagcttgaaaaatgagacctgtacctagatgggcaccaaaagggactggttaacaaatattgcatatacaggggtatggggcggctccagggccagggatgggacggccgcagttgcggcagctccaggacgagcaagtggatcccgggaagcgctgtgagctcccgagccagccgggaggacgcttactacagctgctcagaagcaccgctggaagctcagatgtgagcgccccagccagaagcctagaggggtacagggaagctaccgagaagcccctcctgatgccccagggagcaagccaactccttccaggctccaggaacaccacaaagcaatatgaaacctgttcatgagaggagtcaggaatgccttccaccaaagaaacgagacctccccacaaccagctgctccactaaccacataccctccagtgatgcctctgaatggttcccaggggttgtggtggccgggcagagccaggcaggagccagagtcagcctgggggtgatggagctgtggccatcaccggtctgacagtggaccagtatggcatgctgtataagggggctgtgccacctgccaccttctcaccaactggactcccatctgtgtgaatatgagccccttgcccctggaaaaaaatattgcacgtacagttgattaaatggaatgctccatggctactaggaaggatgaaaatgggttgggcatggtggctcacgcctgtaatcccagcactttggtaggccgaggtaggcagataacctgaggtcgggagtttgagaccagcctgaccaacatggagaaaccccatgtcttctaaaaatacaaaattagccgagcgtggtggctcatgcctgtaatcccagctactcaggaggctgaggcaggagagtcacttgaacctgggaggcggatgttgcagtgagccgggatcgtgacataacactctagcctgggcaacaagtgcaaaactccatctcaaaaaaaaaagaatgatgaaaatgtctgggcatagtgcctcacacctgtaatcccagcactttgggaactgagatgggaggattgcttgagtccaggagttcaaaaacataatgagacttgtttctccaaaaaaaaaaaaaaaaagttattttattatttatttatttttgagtcagggtcttgctctgtcacccaggctggatttcagtggcatgatttcgactcactgcaccctccacctcttgggcccaagtgattctcctgcctcagcctctcgagtaactgggattacaggcacctgccaccatgcccagctaatttttgtatttttagtagagacggagttttaccatgttggccaggatggtctcaaactcctgaccccaagtgatctgcctgccttggccttccaaagtgctgtgattacaggcatgagcaccaggccaaaaaaaaatttttttttaaacttagctgggttagtcaggaggccaagatgggaggatcccttgaaccgaggagcttgaggctgcagtgacctgtcattaggccactgtactcccgtctgggcaacagagtgagatgctgtctcaggaaaaaaatattttaaaaaagaatgatgaaaatgtaatatgtcattagggaacatgtcctaataatgtaataacatatatatgtagaataagttcatttttataaagcaagtatataattgtataagagtacaaaaaaatggccaggcatagtggctcgtgcttttaatcccagcatttttggaggccaaggtgggcggatcaccagaggtcaggagttcgagaccaacttggtcaacttagtgaaacttcgtctccactgaaaatacaaaaatattagctgggtgggcatggtggcaggtgcctgtaattccagctacttgggaggctgaggtgggagaattgtttgaacccgggaggcagaggatacagtgagccaagttcgtgccactggacgttagcctgggtgacagaaaaaaaaaaaagaagacaaaaaaaaaaaagaataaacctggtatcatatatgtagcacacatattagcagtgatcatctttgtgattctatgggaatatgggaaatcctcattttctacattacatatttacatgatgcttgaattgaagagaaaaccaatacggatattttttaaattgtggttgtggagggcaatactaacttattcaagattattcctagtaaagggctactcaaaatttactggtttgaaaactttgttgtcacatgataattgagagcatttgggaactcttacagcaagttgatattgcccagacttccagaagtgtcatcagtagatggttcttgttgaatagggtatagaccgccttgggttactgagcttgcatggctagttgcatgtaaactagtcacatgcagtaaaaccacataccacaccaggcgcagtggctcaaacctgtaatcccagcactttaggaggtggaagcaggtggatcacctgaggtcagaagttcaaaaccagcctggccaacatggtgaaaacccttttctactaaaaatacaaaagttagccaggtgtggtggcacatgtctgtaattctggctatttgggaggctgaggtgagagaattgcttgaacctgggaggcagaggtttcagtgagccgagattgtgccactgcactccaggctgagtgacagagagtgtctccatctcaaaaaaaaaaaaaaaacaaaaaaaaacaaaaacaaaaaaaaggatgccaaatcaaacataacatttcagaaatctatcataggatagccaggcacggtggctcatgcctgtaatcccagcactttgagaggctgaggcaggcagattatgaggtcaggagatcaagaccatcctgcccaacatggtgaaaccccgtctctactaaaaatacaaaaattagcctggtgcagtggtgggtacctgtagtcctagctactcaggagactaaggcaggagaatcacttgaacccgggaggtgcaggttgcagtgagccaagatcacccagcctgggcagcaagagcgaaactctgtctccaaaaaaaaaaaaaaaaaaaaaaaagaaatttatcataggattatatgaggagaccaattttatttatataggaactatctatctttttactagatctctgagctctgggcagagcccacactgaatcctggatctccaaaaagggagaattattatgaggctagaatatgtgatgctttttcagtgcacttaaaaaatttttttaaatgaagacacttctgtgtccggaattggtgggttcttcatctcactgacttcaagaatgaagctgcagactttcgcggtgagtgttatagctcataaaggcagtgcggacccaaagagtgagcagcagcaagatttattgcaaagcgcgaaagaacaaagcctccacagcgtggaaggggacccgagctggttgctgcccctggctggggcagcctgcttttattcccttatctgaccccacccacatcctgctgatttgcccattttacagaaagctgattggtccattttacagagagctgattggtctgttttgacagggtgctgattggtgtgtttacaatccctgagctagacacagagtgctgattggtgtatttacaatcctatagctagacataaaagttctccaagtcctcactagatttgctagacacagagcactgattggtgcatttacaaacctttagctagacagagagtgctgattggtgtgtttacaaaccttgagctagacacagagcactgattggtgcatttacaaaccttgagctagacacagagtgctgattggtgcatttacaaacttgagctagacacagagcactgatgggtgcatttacaatcctttagctagacataaaagttctccaagtccccaccagattagctagatacagagtgctattggtgcatccacgaaccccaagctagacacagagtgctgactggtgcatatacaatcctctggctagacataaaagttctccaagtccccacctgactcaggagcccagctggcttcgcctagtgtatcctgagccagggttgtggtcagagctgtccaccagtcccgcaccatgcacctgcactcctcagcccttgggcggtcgatgggactggatgccacggagcagggggtggcacccgtcagggaggctcaggctgtgcaggagcccaccactggggggttcggcatggccagctgcaggtcccgagccttgccccgcggggaggtggctgaggcccggcaagaattcgagtgcggcgtgggcgggccggcagtgctgggggaactggcgccccctccgcagctgctggcctgggtgctaagcccctcactgccctgggctggccggccactgcaagtgcagggcccaccaagcccacacccacccagaactcgcactggcctgcgagtgccccccttgttcccacccgcacctctccctccacaccaccccgcaagcagagggagctggctccagccacggccagcccagagaggggctcccacagtgaagtggcaggctgaagggctcctcaagcatggccagagtggacgccgaggccaaggaggtgctgagagcgagcgagggcccccagcacattgtcacctgtcacttctaatgtctaaactacactcttccttaaaaaccagagtagtctttggtgcaataattcttttagtcaataagtcaggtaacacaatacaaaagcaagcagtttaagagctgagatgaacttgtctgtttacactcatggggtttcataaggaaaaacaggtttctccccaaaagggagtctggtgccttctctgctttcttgaaggaaagccaggctattataaactaaaatattttaggtgcctcatgcagcagagggtgcaagagaaaggagagacagcagaagtaaatgaaaaaaaaaaaagaattcagtcaaatgagaaaaaaaatctttaggttaaaaaagagagagagacaaggtcctaggagaaaaaaaaaagtgaatgtcttttcaatataaacacacacacatacacacccacacacacatacacgcacaaacacacacacatgcacacatcttggatgttagcttttagttaagctgacttttaatcattgagctcctttaaaaaaatctttttaaatctcattaccataattcagctagaacaaatttctgctatttcagaagtaccaagtatcaaaccaaaaatggcttgatttaggaaacacacccaagctgtcgtggtggaaaaaaagaagccagagcccttagctatggaactgcagtgtggggtgacagccattgctctttcggtttggccaggctagcaaaaaggtggcctcgttatgtaaataaagcccattaagtagtcaaaataaaaaatctttcctgttttttttttcttttcttttttttccttttgttggccgtttttctcccccaccacagtgtgggaatttagccacttcagaggtcttgttccccataatttggaagtttcctttggatttgatcaagttggatagagttgatcaatcacaacggggaaaagactgaaacaacaacaaaaacagaaacaaacagacaacaacaacaaaaataattaagcaaaacaaagatggcacaacttatgcaactactgagtgctgtaatggtaaagagaaattacaaccaactggttgttaatcttgaccttagccaagacaaaccgcatttcagttacccatccttaggtaaggcatgggtctcaggctgaagactgctctttaccatcctagaagcaggaaaaaactcaaatttgtcttccccattggacgcaagctcaaactccataaaggagttacctgcattttatcatcatcgaagcaggaaaaacttgcctttcttgtgttggaagctagtaaaactccaaaaaaaggagttgtacagcaaaataaactttagatcttgaccaaattttgaaagatcagtgattctctggaggggttgcttccaggtctcagcaaattgtcctattggtttgagccataaagatagttcaagctagtaccgagcactgataggagatttgtcaaaggtcaggggcacctccacccagaatcccttcatggttgccaaaatgtgagccttgaatatctgagaaaggtctcagttaatttagaaagtttattttgccaagattgaggatgcacacctgtgacacagcctcaggaggtcctgatgacatgtgcccaaggtagtcagggcacagcttggttttatacattttagggagacatgagacatcaatcaatatatggaagatatacattggttctgtcaagaaaggtgggacagctcaagcagcaagaaggcttccaggtcacaggtaggtgagagacaaatggttacattcttctgagtttctgattagcctttccaaaggaggcaatcagatatgcatttatctcagtgaacagagggatgactttgaatagaataggaggcaggtttgccctaagcagtttccagcttgacttttccctttagcttagtgattttggggccccaagatttattttccattcactgtgtgtgtgtgtttgtgtaggtatacatacatatatgtgtgtatatatatatatatatacacacacacacaaacaaacaaatgaaaaatctcattaagaacagcaagcggtatggtatttttaacttgccctattctattctcatcccctcctcactggctccactgcagccttgaaaattaacagaatgggattggtgagagagggcatgcttgtcttgtgtcggttttcagtgggaatgcttccagtttttgcccattcagtaagatgttggctgtggatttgtcatacatggctcttgttattttgaggtatgttccttcaatatctagtttattgagaatttttaacgtgaatgggtgttgatttttattaaaagccttttcttcatctatcgagataatcatgtggtttttgtctttagttttctttatatgacaaatcacatgtattgatttgtatttttttttttttttgagacggagtcttgctctgtcgcccaggctggagtgcagtggcgtgatctcgactcactgcaagctccgcctcctgggttcacaccattctcctgcctcagcctcctgagtagcggggattacaggtgcctgctaccacacccagctaattttttttatttttagtaagggaagagaccacccctcatattgtcttatgcccgatttctgcctccaaagaaagaaaaagtaaaaactaaaagggagaagtgaaatccacaagcagacagcctggtgccacaccctgggcctggtagttaaagatcgacccctgacttaatcagttatgttatctatagattacagacattgtatagaaaagcactgtgaaaatctctatcccgttttgttccaatctaattactggtgcatgcagcccccagtcatgtaccccctgcttgctcaatcaatcatgaccctcttgcgtgcacccacttagaattgtgagcccttataaaggacaagagttgctcactcagggagcttgcctcttgagacaggagtcttgctgatgcccccagccgaataaaccccttccttctttaacttggtgtctgagttttgtctgcagcttatcctgctacattagtagagatggggtttcactgtgatagccaggatggtcttgatctcttgacctgatgatctgcccgcctcagcctcccaaagtgctagaattacagatgtgagccactgtacccggcccaatttgtatatgttgaaccaaccttgcatcccagggataaagcctacttaactgtgatgggtaagctttttgatgtgctgctggattcagtttgctgagttttgttgagaatttttgcgttgatgttcaccaaggatatttgcctgaagtttcctttttttgttgtgtctctgccaggttttggtatcaagatgatgctggcctcacagaatgaattatgaaggagaaagagtccctcctcctcacttttttggaatagtttcagcaggaatggtactagctcttctttgtacatctggtagaattcagctgtaaatctgtctggtcttgggctttttttgttgttgttaggctatttgttactgattcaatttcagagctcattcattattggtctgttcagggattcaatttttcccttgatcagtcttgggaggctgtatgtgtccaggaatttgtccaattcttctagattttcttttctttttccttctttttttttttttttttgagacaaagtctcactctgttgcccaagctggagtgcagtggcacgatctctgctcactgcaatgtccacctcctaggttcaagcgattctcctgcttcagcctcctgggtagctgggactacaggcacgcgccaccatgcctggttaacttttttatttttatttttagtagagatggggtttcactatgttggccaggctggtcttgaactcctggcttcaagcaatctgcccgcctcagcctcccaaagtgctgggattacaggtgtgagccactgcacccggcctcatttattctagattttcctgtgtgtgcatagaggtattcataatattctctgatggttatttgtatttctttggagtcagtggtaatatcttctccattgtttctgattatgtgtatatggattttctctcttattagtctagctagcagtctttctattttattgattcttttcaaaaaaatcaactcctggattcatcgatcttttgaatacttttgtgtttcaatctccttcagttctgattttggttatttattgtcttctggctttggggctggttttctcttggttcttttattattttagttgtgatgttaggttgttaaattgagatatttctaactttttgatgtgggcatttagtgttgtaaatatccatcttaaaactgctttggttgtgtcccagagattctggtatgttgtatctttttttctcattcatttcaaagaacttcttaattttggccttaagttaattatttacccagaagtcatttaggagcaggttattcagtttccatgtaattgtatgattttgagtgaatttcttagtcttgatttctaatttgatttcactatgggctgagaggttggttgttatgatttgagttcttctgcatttgctgaggagtattttgtgtatgattctgtgactgattttggagtatgtgtcatgtggtgatgagaatgtatattctgttatttttgtgaggagagttctgtagatgtctatcaagtccatttgatccagtgctgagttcaagtcccgaatatcattgttaattttctgccccagtgatgtatctattactgtcagtgagatgttaaaatctcccactactattgtgtgggagtctaagtctctttgaaggtctctaagaacttgctttatgaatctgggtgctcctgttttggatgcataaatactaatacttagaatagttaagttttcttgttcaattgaacactttaccattatgtaatgcccttctttgtgttttttggtctttgttggtttgtaaagtttgttttgtctgaaattaggattgcagcccctgatttttttctgttttccatttgcttggtagatttttctccatccctttattttgatccagtgggtgtcatagcatgtgagatgagtctcttgaagatggcataccaatgagtcttaattctttatccagattgccatggtgtgccttttaattggggcatttagcccatttacattcaaggttagtattgatatgtgtggatttgatcttgtcatcctgatgttagctggttattacgcagtcttgtttgtgtggttgctttatgctgtcactgctctgcatacttcaggatgtttttgtagtggctggtatggtctttccctttcacatttagtgcttccttcaggagcttttgggcagatcttgtcataacaaattctctcagcatttgcttgtctgaaaaggatcttattcctccttcacttatggagcttaatttggctggatatgaaattctcagttggaatttctttttattaagaatgttgaagataggctgcctatctctcctggcttgttggggttctactgagaggtccactgttagcctgatggggtccttttgtaggtgacctgacctttctctctagctgcctttaacttttttttttcattttgacctcagagaatctaatgagtatgtgtcttggggatgatcttcttgtgaagtttcttactagggttctctgcatttcctgaatttgaatgtcggtctctctagctaggtcggggaagttctcataaatgatatcctggaatacacttcccaagttgcttatactctctctatctctttcagggacaccagtgagtcgtagatctggtctctttacataatcccacatttctcagaggttttgtttcttccttttaatttttttttcttcattcttgtctgcgtgtcttctttcagaaagccagtcttcagcccctgagatactttcttccacttggtctattctgctattaatgtaattcttgtagtgtgttttttagctctatcaagttggctacatccttttttgtactggctattttttctgttggctcttgcattgttttatcctgattcttagcttccttagattggctttcaacatactcctgcatatcgaagatcttcatcccaatccatattctgaattctatttctgtcatttcagccatctcagcctggttcaaaccccttgctggagaggtggtgcagccgtttggaggaaagaaggcactctggttttttgagttgtgagagttcttgcactggttcttttttatctttgcagggttattttccttcaatctttgaagctgctgacctttggatgggtttttttccttttatcctatttgacgaccttgagggtttcactgtggtataaggtggattcagtcaactggcttcatttctggaagagtttagaggaccaacactgagctcccaactcctggactgtgtgctgtaaccctggaggacttgtatcgagccccaactttgttctgtctcctcaaggataagaatccactgcactgggtgagccaagatgctctcagactgctggtcactacactctaacgggtgatgtcagccaaagcttttagtagtgcagagacagtggaatccatccccatttgcatgtgccagcggcagtggcagcagcagcatggctgcagtagggtgctagtgggtgctggcatgcctgcctctgtggcagcatttaccacagcagcaaagggaacacagctggcagggtgggggccccttctggtgtctgtgcatgtggttgcaccagtagtggtgttgacatggcagcagggtgctggagagcgctcagggtagggaagagtctgctgttctctgtgcctagtttcacttggagcagtgctggcaaatgggtggggcactggcaggggaggggttggggctggctggctctgtgcccaccaaggctctgactacagtggtggtcagaagggagagtggagcagactgcactcctgctgcagtacttgcagggcagggtgtacacatacatgcaggctggcaggacaagataagcagaagctgcccatgcacacacatgttggcaaagccatgtgcggtgttaccgtgggccttggggaagatgcagtgtagaaggagtgtgtgcactggtgtgtggccctgggagctgccccgggggagctcttcgcatttcaggcatggtccaccagcactggagctatgatgtgggcccctagggtgctcaaggcttccctgcaatcaggcatggccaggctggaccctcagagaggccagcgaaccaaggagtgctcaggtaggaccagccctgcctgatgagtaagactgcattgcgaagttcaggcccagtggttcccttagggtgaaagtctcctatgggagcaagttgagtctaggggtgtggctgtccttggctgtgctccactacagctgctctcacaccaaaccctctgggttcatcagctggctgctgccctggctgcttctccaagcttctctcccttgcaactctactgtccatgatgctcaaaggatctcctgccaggattccagaggctggacataagaagcattgcttcttgcaagttcaactcaccctttcccccagtcattgggggccaggaatgagttccagggtgcagtagccccatgcaggcctcccagcttactacccctttagcctagcttctgtgtcttccctccatctactctcagtgccttccctctgaagatccattagtagtgcaccagtcaaatcagtccctcggtggcagctgttgcacctggctgcatctagttggccatcttaacatgtatatttccataactaatttttgtgtgttgattttgtaccctgcaattttgctgaattaaaattagctctagtaggtttatttgtttgtttgctttttggctctgtcacccaggctggagtacagtggtgcaatctttggctcactataacctccacctcctggcttaagtgatcttcccacctcagccttctgagtagctgggactacaggtgtgagccaccacaccttgctagtttttgtactttttgtagagatggggttttgccatgttgcccaggctggtcttgaactcttgggctcaagcaacctgcctgcattaacatcccaaagtgttgggattacaggtgtgagccaccatgcctggccagtaggtttatgtatgggtatatgtgtgtgtatgtattctcttttcttgttataggtctattgagattttctatttcttcttaagtcatatttggtaatttgtgtgtttctaggaatctacattttatctagatgtctaatttttggaatataatttttcatagtattgtcttaaaaatctttaaaatttctgtaagatcagtaataatgtcaccattttctttctgattttagttatttactattctctttttttttctgagtcagtctaactaaaggttcatcaaatttgtttttttttcccatgaaccaactttttgttttgacaattatttttcctctattctctatttcattctgctttaatctctagtatttccttccttcagctggctgtaggtttagttagctcttcttttacaccttaggtcaagcttgtccaacatgcagcccaggataactttgaatgcagcccaacacaaattcataaactttacaaataacagaaaacagtatgagattttcttgaggtttttttttttttttttttttagttcatcacctattgttagggttagtgcattttatgtgtggccccgtagcaggacgagctgcagacaaaactactcagacactgagttaaagaaggaaggggtttattcggctgggggcatcagcaagactcctgtctcaagagcgaagctccttaagtgagcaattcctgtcccttttaagggctcacatctctaagggggtgcgcatgagagggtcgtgatcgattgagcaagaagcaggtgtgtgactgggggctgcatgccctggcaattaagaacaaaacaggacagggattttcacagtgcttttctatacaatgtctgtaatctatagataacataaccgattaggtcaggggtcgatctttaactaccaggcccagggtgtggcgctgggctgtctgcttgtggatttcatttctgccttttagttttttctctttctttctttggaggcagaaactgggcataagacaatatgaggggtggtctcctcccttagcccaagacaattattcttccaatgtggccagggaaaccaaaaggttaaataccccttaggtgtaaagttaggttgttaatttgaaatcgttccttttatcttttctttttttttttttttttgagatggagtcttgctctgtcactaggtttgagtacagtgtgcgatcttggctcactgcaacctctgtcccccgggttcaagtgattcccttgcctcagcctcctgagtagctgggaatacaggtgcgcaccaccatgcccagctaattttttgtattttagtagagacggggtttcaccatattggccaggatggtctcgatctcctgaactcatgacccacccacctcggcctcccaaagtgtcaggattataggtgtaaaccaccgtgcccggtctttttttttttttttaataaaataaatatgaaacacttcacgaatttgcatgtcatccttgcacaggggccaggctaatctctgtattgttccaattttagtgtatgtgctgatgaagcaagcatgagattgtccttttttaatgaaagtatttattattattattattttttgagatggagtctcgctctgtcgcccaggctggagtgcaatggcatgatctcggctcactgccagctctgcctcctgggttcacgccattctcctgcctcagcctccggagtaactgggactacaggcgcccgccactgcacctggccaattttttttttttgtatttttagtagagatgggatttcactgtgctagccaggatggtcgcgatccacccgcctcggcctcccaaagtgctgggattacaggcatgagccaccgtgaccgtctgatgtaagtatttccagctataagtttcactgagtacccctgtcacaccatctcataaattttggtatcttgcattttattttaattcatctgaaagtatttcaatttctctagtcatttcttctttgagccactggttaagaatgttgtttaactttcacttacttgcaaattctccaggttttcctgttattgacttctagcttcattacacttttgttggaaaagacactttgcataatttttttttttttgagacagagtctcagtctgttgctcaaggtggagtgcagtggtgtgatctcggctcattgcaacctctgcctcccagattcaagcaattctcctagctcaaccttccaagtagctgggattacaggtgcctgcctccactcccagctaattttttgtattttttattagagttggggttttgccatgctggccaggctggtttcgaacccctgaccacaggtcatccacccaccttggcctcccaaagtgctgggattacaggcatgagccaccaagcctggcctgttttttttttttttttttttttttaagacaagtcccgctctgtcctgcaggctggagtgtagtggtatgatctcaggtcactgcagcctctgccttccaggctcaagccatcctcctgcctgagcctcctgagtagctggggctacaggcgttcaccaccactacagccggctaatttttttattttttattttggtagagacagggtttcaccatgttgcccaggctggtcttgaactcctgggctcaagtgatccgcctgtctcagcctcacaaagtgctgggattacagctgtgagccaccacacctggccctttgtataattttgaccttttaaaatttattgagaattgttttgtggcctaacatatgatttatcatggggaatgttccatgtgcacttgagaggaatatatattctgctcttgttagatggatatctttccatatgtctgttaggtctatttggtttagtgtgttgttcaattcctctagttccttactgattttgtctagatgttctatttactattgaaggtggggtattgactggacacagtaggtcaggcctgtaatcccagcactttgggaggctgaggtgggcgaattgcttgagcttgggcatttgagaccagcctgggcaacatgatgaaaccccatctccacaaaaaatacacagattggccgggtgtggtggcgtgtgcctatagttccagctactggggaggctgaggtgggagaatcgcttgagtctgggaggcagaggtcgcagtgagctgtgatagagtcactgcactccagcctgtgttgaagtctctgttattgtaaaactatttcttccttcaattttgttagactgtgcattttagagccctttttttttctttttcagttcatacgtatttataattgttacatcttcttgtgatttgactctcttaccaacatacgatgtctttctgtaacattttttggcttaaaatctattttgtctggtattagtatagccaccccagctctcttttggttactatttgcatggattatctctttccgtcttttcattttgaaacaatttgtgtcttgggtctacagtgagtattttgtaagttgcatatttggattgtgtattacatcatttaaaaaaaatccattctgccgatctttccattggtcagattatttacatttaaagtgattactgaaacaaaaaagttaattgaccggcatggtggctcccgcctggaggtgaggctgcagtgagccatgatcgcaccactgctcttcagcctgggggacagagagattgactcaaaaacaaaaaacaaaaacttacttatggttggactcaggcctgtaatcctatcactttgggatgctgaggtgggcagattgcttgagcccaggcgtttgagaccagtctgggcaacatagcaagactcctgtctctacaaaaaatagaaaaataagctgggcatggtggtgcacacctgtggttccagctactcaggaggctgaggtgggaggatcagctgagcctgcggaggtcaaggttgtagtgagccgtgattgtgccactgcactccagcctgggcaacagagctagaccccgtctcaaaaaaaccccaaacaggccgggtgcagtggctcatgcctgtgcctggcactttgggaggccgaggcaggtgggccacttgaggccaggagctcgagagtagcctggccaatgtagtgaaaccctgtctctactaaaaatacaaaaaattacctggctgtggtggtgggcgcctgcaatcccagctactcaggaggctgagtatcacttgaacttgggaggcaaaggctgcagtgagctgagaatgaaacactgcactccagcctgagtgacagagcaagactctgtctcagacaaaccccaaaaaagaaaaacagaaaaacctatacaccaaagaacttacttacgtcatcatgctgtttagtttctacatgaagtgttttgctcctcagtaccttcttttgtgtttggttaatgatttatcctgtaatattttgatcctttcttaaattcttttctgtatattttaaaagttatttttttagtggctactatgaagatttcatttaacatgctgagttcaaagtctagttcagactgatagcaactcagcttcaatagcatacattaactctgctcctttctctgtcccctacctatagttaacaaattatgtctttaaacaattagtgcctattaacatagatccatattattttatgcatttttttttttttgagaaggagtctcgctctgtcgcccaggctggagtgcagtggcgcaatctcggctcactgcaagttccgcctcctgggttcatgccattctcctgcctcagcctcctgagtagctgggattacaggcacccgctaccatgcccagctaattttttgtatttttagtagagacagggtttcaccatgttaaccaggatggtctcaatctcctgacatcatgatccacctgcctcggcctcccaaagtgctgggattacagacttgagccaccgcgcccggcctttatgcattttttaaatcacaaagaggaatagcatacccaaaatacagtaatactagcttttatatttagcgacatagttgcatttaccagtgctctttatttcttcatatagctttgagttactatcttgtatcctttcattttagcctgaaggactcactttagcttttttttttgagcccgagtcttgctctgttgcccaggctggagtgcagtggtgcaatctccactcactgcaacctctgcctcccacattcaagtgattctcctgcctcagccttccatgtagctgggattacaggcacgtgccatcacacatggctaatttttgtatttttagtagagatagggtttcaccatattggccaggctggcctcaaactcctgacctcaggtgatctacccacatcagcctcccaaagtgctggtattacaggcatgagccactgtgcctggccaagaactcttatatttttattcatttattatttttgtttagtgacaggttcttgctctgtcaaccaggctggagtgcagtggtgtgatcagagctcactgtaacctccaacttctggtctcaagtgagcatcatgagtagttggaactacagatgcataccaccatggccagttaattttttaaatttatattttgtagagatggggtctatgttgtccaggctagtcttaaactgctggctgcaagcaatcatcccgcctcagcctcctgaatagctaggaccacaggcctgagctaccctgtctggctaattatttttattttgtatagatggggtctccttacgtcacccaggctgcttgtggactcctggcctcaggtgatcccacttcagcctcccaaagtgctgaaattacaagcgtgaacccatgctgagctcccccaacccccccttttttttttgagatggagtcttgctctgttgtccaggctggagtgcagtggcaccatctcagctcactgcaacttccacctcccggactcaagcgattcttgtgcctcagcctcagtcagctgggactacaggtgcacgccaccatgcctaggtaatttttttgtatttttagtagaaatggggtttcaccatattggccaggctgctctcaaactccatccacctgccttggcctcccaaagtgctgagattacaggcgtgagccaccatgcctggccccagctccacttttgcattcttttttttttcttccctgagagtaacatgggggagactttagcattctttataacacaagtttactaatgataaactcccttgacttttctgggactgtcttagtttccttcatttttagaggttatttttttttttgaaagatataggattcttggttgactttttgctgtcagaacttttaatatatcatctgtcagtgggagagaggggaagaagtgtcctactgccttctgtactccgtgatttctgataagcaactgttaatcttactgaagatcccttgtacaggatgaatcacttacctcttgctgctttcctgtctttaactttctacaatttgataataatgtgcctcagtgtggatctcttttagtttatcctgctttgaatttgttgagcatcttgaatgtgtagattcacaactcccatcaaatgtgggatatttttggtcactatttttattatttatttatttatttatttatttatttagagacggagtctcgctctgttgcccaggctggagtgcagtggcgggatctcggctcactgcaagctccgcctcctgggttcacaccattctcctgcttcagcctccccagtagctgggactacaggcgcccaccaccttgcccacctgctaatttttggtatttttagtaaagatggggtttcaccatgttagccactgcacctggcctggtcactatttcttaaaaaaatctttctaggccagggcacagtggctcacacctgtaatcctagcactttgggaggccaaggtgggcggactgcttgagcctgggagttcaagactggcctgggcaacatggcaagaccttgtctctccaaaaatacagaaattagctgtgcttggtggtggtatgggcctatagtcccagctacttgggaggctgaagggggaggattgcttgagcctaggaggtagaggctgcacttagccatgagccgtcagatcacaccactgcactccagcctggaggacagagcgagaccgtctcaaaaaaaaaaaaaacaaaaaacaacaacaaaaaaaaaccatagggatatatctatctgcatgactatagattaggcaatggtttcttacatacaccctaaagcacaccaaccagaggaaaaattaattatgttttctcaagattaaaaaggagactatcaagaaagcacaaagataacagattgagaggaaatatttgcaaagtatatgcatgataaaggtcaattatctagaatatatatttcaaaaattcatttagagatagggtcttgctatgttgcctagactagtgttgaacttctgggctcaggtgatcctcctgcctcagccttctgagtagctgggaccataggcctatactaccacaactggctgtggaatatgtaaagcacccttaccactcaataatgcggacaaaacccaatttaaaaatgagcaaaggctttaaatagaataaaaatgaaacatttaagactgctgaaagtggttgccttggggcagtggaaaatggtgaggcaggtggtgtctggattggaggggacgagctattgtgaacaataaaccttgtatcactatttggctctctggatcacggttcataacaagggatgaatttgttccacaggggacatttggcaatctgaatatatttgtcattgttataactgagggggtcttcctgacatctaatgtgtagaggccagggatattactaaacatcctacaaggcagagaattacatagcctaaaatgtcaacagtgctgaggtgaaaaactgaagtatgtttgaggctggacgtggtggctcatgcctataataccaacactttgggaggctgaagcaggtggatcacccgaagttaggagttcgagaccagcctggccaacatggtgaaaccccgtctctactaataatacgaaaatttgctgggcatggtggcgcatgcctgtaatcccagctactccggaggctgaagcaggagaatcgcttgaacctggaaggcggaggttgcggtaagccaagatcacaccactgcactccagcctgggtgatagagtgagatttcgtctcaaaataaataaataaatgaagtatgtttgataaaaatacaaacacaagtcaataaaagtctgttaaaaatattaaaaaatcataaaaacaatattttgtacaatatccatagatgtagttttcttcatgtgccatgctttgactaccttaacaaacagcagggctgggaaagcctgtcagggatgtttagtgaatatggaatttatttgcttgtgagttaacatgccaggcttttctttttttttgagacagtctcactctgtggcccaggctggagtgcagtggcgcaatctcggctcactgcaagctccgcctcctgggttcacgccattctcctgcctcagcctcccaagtagctgggactacaggcgcccgccaccacgcccgggtaatttttttgtatttttagtagagatggaatttcaccatgttagccaggatggtctccatctcctgaccttgtgatccgcctgcctgggcgtcccaaagtgctgagattacaggcgtgagcctccgtgctcagccatgccaagcgtttttaaaaaagtaaatcagctctttggctagtcatggagtaaaaaaaaaaaaaaaaaggaaaagagaaaaaatatagaaaaaaggaatgaccaatcctactagttagggtgccaaaagcactgaaaattcatgcctttacttctcatctccttaatcagggatattagaatacactggtgtagaggctcataaagcaccagttaagtcttcttcaggtgctatataagtcatctatggctatttcagaagcaagtaacttgagtatcgtgtgtgagttttaaaaataattgaaaataggtcaggcacagtggctcacccctataatcccagcactttgggaggccaaggtgggtggatcatgaggtcaggagtttgagaccagcctggccaatatggtgaaactccatctctaatcaaaatacgagaaaattagctgggcgtgctggcacgcatctgtagtcccagctgctaggaaggctaaggcagcagaattgcttgaacccagggggcggggggttacagtgagccgagatcacgctactgcactccagccttggggacagagcgagactccgtctcaaaaaaaaaaaaaaaaaaaaaaaaaaaagaaaatttctgtcaaggtaaaaagagtaattgaccagatttttaaaaactaaaaccttcaggagccaaaattactgacactagtgctctcatctttatatagctagcacaggcaatttagttttctaatattactatcaacaatactcctcaacattaatctttaaaaaattaccattggccaggcatggtggctcatgcctgtaatcctagtactttgggaggccaaggtggaaggatcacttgagtccaggagtgtgagaccagcctgggcaacatagggagacctcgtgtctacaaaaaaataaaaacaattagccaggtgtcgtacccatacatgtggtcctagctactcaggaggctgaggtagagtaactgcttgatcccaggaggtagaggatgcagtgagccgtgattgcaccaccgcactccagcctgggtgacagagcaagacactgtctcaaaaaacaaaaaccaaccccccaaccaaaaaaaaatcagtatttccaatatatagtcaaaggccaccactaagacttatcccacattcacatgacttaaatctgctgccccaccattattctaacattctggaactggtttttgtatcactttcccccttacacattttagtagcccacctagagtgcagatagacaccaccatgctggggaagggctcactatgcccatatactgggggcctgtttatctgactgaccctatgccaggagcatgcagaggcagaactgtgacatacggacaaagaccaaatgaaagccaggcttcacactggcagttaagtaactggtggaatcaagtctagaatccagttctgattacagttagtattctctcttcaatagttgttacattctgtggctaaattattccacattaaatcccctttagtgaaaaacggcactaaaagttacttcactatcagctttcaacattagagcctctttctcaagaacagctgttcatattatttaataaaatacaaaataattcgagaataaagactatgctttcagggatcatttctatagttcgttactcgggaagtttctctgaacgtgtaaagcaccgaacaaaaaaaaaaaaaacaattcaagaataaaatctgggcagctcacaataaagtggaaggaaatgttatacaggtggtcgctataaacatttcagaaatccaattgcagtattataacttatgaaaagagaaactaccacatgtaaaaacacagaaaagaaacgtaagttttggaaaacgtagacttttaataactgcttttatcaccaggttaagccatgcagttacaaagtagttagaaatttctgaagggtgttagagttaaaaaaaaaaaaaaagctgactcttacacatatattatctagcacttcatggggacactactgttcaaaaggccctggccaaataactcccaaatgaaacactcaacccaaggatgttttcagcccactgttagtgaagctgggtgcagaatgcaaagcctctaaaaggagaggatacaaagtcaggtgagtaggggccattggcaatgctcagagccagccagactccaaacagggagcccaagtggtttttttctgggacactctacttgaattattgtttaattagtcaaccatagatcttcaaaagagaacaattagttaacatgataaaaagtgactgcattctttggactgtatcataattatagtaagcaaattctgacagttttaatgaaaatagcctccaccattttgcaggtatgaagataacttaattatccacagggcttttaatgtctgctggacaatacatgaatgataagctataaatgacattgttttatgatataaaaatactagtttttttcatttattatttctataggcattcactgtttgagtcaaggttaggcttgttaagtgattaaaggcaattttattacagcagcatgtacttattctattctaaaagaataatattcataaacagaaacaggttttatatttgtttgcaacctgcaaaattgaattattttgctgatataaaatactaagaactcacttgaggaccatgccaccttctgaaaaggccacacacctacttcttaaatgtgttaaagttacagtgtgtcccagactcatccagaaaaaataagcaagcaactgactgctcttgactgttcctccccagcactagcactgattgtgttgggaaaagccacagagcaaggctgcacagccagataaaggaggctttttatttaaaggcaaaataccaaaatggctctctggtgtaggtgatttctactttcacactcagcttgtacatgatccgctaaccttaatttctttctccttaacgggctgacttggattgacttgttgagaatggtatccattattaatgagtcaggagagaaagggatttctgtggttacatgtaaacttgtgataggtctgcagaagttacatgtgaagaggatagtgaggaagtcagccatgatccatctatgtgaaggtcacaccagcttcattgtacactttgaagactttctcaatggcattaacataggcagctgttctcaggtccaatcccaggttatacttcatggctgtgcgcataatttgctgaaatgaaagagaaaatgcagtgaagatgatcctgactcaagtggccaggccataaacacacaaggcccagacaggcctggtccaagttaccctctcattgtttcaaggcaggacttgggcagccaaagacaaactactctagcagcagaacctctaggcaggagggcctaattctctggacttaacaatggggtggctgggtgcggtggctcacgcctgtaatcccagcactttgggaggccgacgtaggcagatcacttgagctcaggagttcaagaccggacttgccaacatggtaaaaccctgtctctactaaaaatacaaaaattaggcaggggtgcggttgctcacacctgtaatcccagcactttgggaggctgaggcaggtggatcacttgaggtcaggagttcgagaccagcctgaccaatatggtgaaaccccatctctattaaaaatacaaaaaattaaccgggtgtgggggtgggcgcctgtaatcccggctactcgggagactgaggaaggagaattgcttgaagccaggaggcggtggttgcagtgagcagagattgcaccattgcactccagctgggtgacagagcgaaactccatctcaaaaaactaaacaaaatgaaaacaaaatcaaaaattagttgggcatggtggctcatgcctgtaatcccagctactcgggaggctaagggacaagaattgcttgaacttgggaggtggaggttacagtgagctgaaagtgcgccactgcactctagcctgggcaacagggcaaaactccgtctcaaaaaaaaaaaaaaaaaaaaaaaaaagggagtgatgaaaatgttctagaattataaagtggtgatggctcaaatatataataaaggatgccgaatttaatactttgaaaggatgaatttataccacatacaccctatctcgatcaaaaattaacaagaaaaacaacagccctaagaagcaccaccttcttcaccaatatctgcttatgctatttcatcataaatccaagcagatagaatctgaacccaagaagaaattaggaaaactggactcaaactgtggttgaggccttaaagtagggatcaagcagtcaaaataagttttgcttataccaaattctatagtaaggtagactcccgtagctataacatagtggcacatggagctacaatccagtttggctaactactccatactgggctagctgccaacatcattacctcctaaatcagccttattatttctttccaaagcctcaaaaacatatttgaagactctaaaaaattgcttatcatctgagactgaaaaaacatgtgttttgctacacacaaatgaggaccattgaacagattgatgttttctatcagcacatacagtctggcggctgagatagcatggttgagttgcacttcatgtgactagctggaaggcaaacagcatctgcacacataccctggcagaacgctccattgtgtatgccaagccagagtgcacgatgtctttctcagatgcaccctattagggaaaagaacacaagtttaacaaaaccacaaagacctgctttgtgtccctgtataagatgacaaaggattctcaagtcaatatacaaccagacagaattttttgtcttttagctaagatatgtcatttctgcacagtatcaaagatacagtatcttgatacttactgaagcagttgcttgttgatcacaatttatttttattatatttgacagcaaacaaatactcatgaaataagattatagtacaacaatgaagacagtttttggacctagagacatgagggcatggagtgagatgagcaccctccactcatggagacgcagatgcactgagcaatgtgttacactgttcatgccacggtgcgttcgcctcagctccccagagaacagggacaccacacagaacacagaaaggaatctgattaaaccccatagcggctttggggtagaattctgtgtatctattcagtagtgccagcaacttttaaagctgtgtagatctcagcagcgttttaattttactgatgaggaaactaaggaccagagaagatggccaaggttacagatagctattttcagagctgggatatgactcagggcctccaccatcaagtcagttctctctttcctaatttgtttcttggaatgctttctaaaaaattaaggacaattaactcactaccactcttaaggtgacatacagagctacaaaacacatatgcccgataaaaacttaaaatgggtcactgatatagtttggacacttactgagtacatactcttccaggtactaggggacatagtagagaataaaatcaaaattctgttctcacagactttatattgtagtgggaagagagtgtatatacatggacttcaaaccacaaggctaagtggatcattgaagttttcaatctagatagagaagtggtttagggacgcaggccttccaatgttaggagagtgaagagttgaagagataccagcaagaggcaattgagaagaaatgtttagtgaggtagggagaaaaccaggagaatgtggtatcctggaagctaagagaagaaaatgtttcaaggtgggagtgtcagttgtaacaagaactgctgataggtcaagcaagatgaggactgaaaaatagctactggatttggcaatgctggtgtcactggctgtcttgacaagaatagtcttggtggagtaggttcaagtaaagaagaattggaggctgagtatatacaactcttccaaggaggtttgctctacaggaaacaaatggcaatactggaaggggaagtgggattaagatttatacattttttaaaacagcatttggtaagctgaggggaatgactcagagggaaactgctgatgtaggagagaggagcagacttgctagagcagtgtatctgaggaaaaaccatccaatgcccacaacaagaactggacctaagaaatgaaagcacaaagagctgatctattcgaagagagatgacacaggactgggtacaggtaccaggagctgggtagatgcggaagctcccaggctgcatcagttttatctgtgaacagatagcaggtcatgagctggaatgcagggcagtgagaagaggagaaaatgtgatgtaatcactcaggagacggggagaatgaatgaaacacggaaaagcagtatgactgctgggcagctctgagcgcctacttgaggttagtggtcagggtgtgaactgccagcagggcctcctacagggtagaggcacgggatttaatcagggatttaatcagggctgctgggatttaatcagggcttaggtgttaacaaaggagtatgacaaaggaaacaagactggggagtgactgtaatgatggagcacggaatttaagttagataaggagggaagtgagggcactggggggatgagggacagtggaaacatggcagggtcatgatgtgggtcctgatagtgccaaacaggggcagggggaaactagagggagagagcttgagaaaacttttatttttttaactgacaaggcatatgctgggcagtggggtgaccaaagggaggggtgaacagccctctggcagggacagtagcagcgcaagtccttccgatgcactgctagccacttgggatggatgttatgtacgaaacagtggcacacaggagactttcagagagagccacagaactgcagtgacacttaagcagggaggagatcagtgtattccagataaaaggaccagaacaaagacatcactctaggaaataggaagtttactgaggggaacggttagtacctagaatgggtaaagcattttttctttctttacaacaaaatctttaactttttcccatgttgcaatatagtctcagaactgttttccatcactgaatatttcataaggagatatattgacggccgggcgcggtggctcacgcctgtaatcccagcactttgggaggccgaggcgggtggatcacgaggtcaggggtttgagaccagcctgaccaacaaggtgaaaccccgtctgtactaaaaatacaaaaaaattagctgggtgtggtggcgggcgcctgtaatcccagctactcaggaggctaaggcaggagaattgcttgaacctgggaggcagaggttgcagtgagccaaaatcgcaccactgcactccagcctgggtgacagatcgagactctgtctcaaaaaaaaaaaaaaaaaaaaaaaaaccaaaaaaaaagaagatataatttacccattgtaatatattcttaaactatgagtgaatattacctaagatgtattataagatataagtcagccatttccctgctcctaaactttaaataaaaccaaatttaaaaactgtttacaccgtttctttttttttttttttttgagatggagtttcgctcttgttgcccaggctggagtgcagcggtgcatttcttggctcactccaacctctgcctcctgggttcaagcgattctcctgcctcagcctcccgagtagctgggactacaggtgcgtgccaccatgcctggctaattttttgtatttttagtagagacggagtttcaccatgttggccaggctggtcttgaactcctgaactcaggtgagccacctgccttggcctcccaaagtgctgggattataggcgtgagccaccgcacctggcctacacatagtttcaataacatcatcgtgcatggagtggttcctcctcttttgaattattttcttaggataaattcccagaggggagattgtcatagcaccaaagggcaggaacactttaataacttcacattttccaaagagctgcaccaatctacaccgtcactagaataaaggtacaactgtttcaccacatatatggagaacataagatccattgtttttgttaatacattaaaaaaaaaaaactctttttcaatttgtatttctttaacaatgaggttaaatttttcccccaggcttatgtgttatggacttttgtttttcctgtcttccatcatttactggtaaagaagtttccctccctccatccctcctttcttttttttggcggggggaggggggtggcggcggcgggaacggagtatctctctgttgctcaggctagagtgcagtggtgcaatctcggctaactgcaacctccacctcccgggttcaagtgattctcctgccttagcctcccaagtagctgggactataggcgtgtagcaccacgcctggctaatttttgtatttttagtagagacggggtcaccatgttggccaggatggtgtcgatgacttgacttcgtgatccacccgccttgacctcccaaagtgctgggattacaggcgtgtgccaccatgcctggcctcttgtttctttctttatttttgtagagatggggactcactatgttccccaggttggtctcaaactcttggactcccatatagttcaatctaatgcttgcttttcaattcttcctatttctctgaagcttaaaataattaaaatacataataatccttcactgttaaaacacgtgcgtgaaaaataccaaatttatttattttatatttgttagtagtcagtaggattcttactccagttttagaatgtaatgaaaaggaaaggtacaaaacacacatgtcacgcacttactgtcaagctaattacaaagactatgccgcagatgaaatccatctaaccagctctgtctgaaggaaagagcagggagcatgtgtgaagtacaactgtggggtcaccacactcaccgatatcctgtcttggaactctgccgtgggtacaatgggaatagttccaccatgctttccaaattttctttctaaactctcttgaacagacactacaaaaaaataacaagagatcaagatattgctaacagaaaaaaaaaaaaaaaagtagaatcaaaagtagtcccaaactataactgtaacccaaaaacttatacagacagagtcgtggtctgtcacccaggctggagtgtagaggcgtgatctcagctcactgcaaactctgcctcccgggttcacgccattctcctgcctcagccttgcgagtagctgggactacaggtgcgcgccaccacgcccagctaattttttgtatttttagtagagacggggtttcaccgtgttagccaggatggtctcgacctcctgacctcgtgattcatctgccttggcctcccaaagtgctgggattacaggcgtgagccactgcgcctggccttatacagagttttaatgacataaaagggttaatcatttaaaactcagtcaggaaggaataaaacacattgccaatttcctatataaatgtgaatttaggtcactgctctgtttccataacacccattaccagggtttttccttggctctattaaaaagaaaacgctgggggaaaaagaaaaggaaatagatggaacacttcacccagattctcacagtgggctgagtacagaagctcagtaggaggtcttggtcttatttcaactagatgagaaattctactcttaactgtggagcttactctagtcaaagaaaaacaagtattctcatcaggagtctcaaaaacaattcttgacactagataggcctttactaagagcaaccagagacagaaattagtatcgacagtggagttttaaaatcacacttaaaaaaatattattggctgggcacagtggctcacgcctgtaatcccagcactttgggaggctgaggcaggcggatcatgaggtcaggagatcaaggctatcctggccaacatggtgaaaccccgtctctattaaaaatacaaaaattagccgggcgtggcggtgagtgcctgtagccccagctacttgggagggtgaggcaggagaattgcttgaacctgggaggcggaggctacagtaagccgagttcgtgccactgcactccagcctcggcgacggagcgagactccctctcaaaaaaagaaaaaaaaaatgtagattatattctgtgaatattacatcacagaataaaactctggatataatatatgggagagttaatatccagaaagacattgtgcatttttggtctaagtttcatgagacaaaatattattttcttttctgagactcaattctttcccaaagggatcagttctcttaagtggacctttttacagcctttcagctggctcaaaagatgagttttggcgaacaagattatcgatactcactgagcaagtggtagttagaatccctttcatatttgaaggtcaaacggccatagctgacatgatttagattcttcagccactcaaagtaagatactgtcactcctccagcattcaagtagagatcctatgcacaaaaataagacaaagaaattagaagatgatggttttcgtaaaagctgaaaatgaacctaagaccttaatttcaataccaaggtagactggactttaaatatcgcaaatatattttagccagtatcaggaatttcacacttaattaacactccttcccatcccacccaattccatctaaggctttttctatttaggaaaaaaaaaaaatcattttttggcttattaatcaaggaaagttaataatctttggttggagcctcttctctaccagaagttagttctcagactaaatggcttgcccaccaaccagttggactggactgtccacagggcctctcagaagacaggattctttctcctattacctaagggtagcccatttcagttacattaaatgtcttaagtgctttcagcaaagggggttctttaaaatatattccaagcccacattaatttctagtaactttttggtgtagactcatttttacttgctaaaaaacctgagcacgtgttcctcatattagttttctgagtaaagctggaaagggcacttgaaatgcataaggttaggaatcatatagaaaatcttaagagctttagttagaatagtgtttctaacacagtacacatttatataaccagactcttagaaggctaaagacattcagtaaagagcctgaaattggaataaatgtttcgatcaaagtgaaaattaacaggcttagaattaaccatgcttctactatattttctcaaaagtgaaaaagatgaattcactagagcttggagactaataattcctctcttcctccaaattccttgcaaaagactattatgattctaagtacatataaagcctaataaatatagatgacttactggaataaccataatgtttctctccaggaagatcttgtcagcttctggagttgttggcccattggcaccttcagcaatgatctgcaagagagtcaggaacatagagaaatgcgaacaccaccgtcaaatcccctccactgagggcaagagatgtgcatatatgaacaaggggctgtggggagaagcacagtttcagttaaagttaaatagaggttatttttctctgccaagtgtataaaactacctttcacttttctatttatctaggttttttttttgtttgcttgttttttttttttacaggagtgtcaggcagatgcgtttgttttggtaatggttgcacaactctgtgccggtagctaaaagccattaaattatgtaccttaaatgggggaactgtatggtatgtgcagtatgtgccaataaagctgctaaaaagaaagagaaaactcaatcagactcttctatgacccccctaacgtcattcacattgataatgttggttctggtttctataatgttgtcaccttggctttgactctgggtgcgttggatttggtcaactgcttctcactggcagctgggatcagtatgtcacagtcggcctccaagatgcttccttcatagggctttgccttggggaagcccagaatggacccatgttgctgccattgattgaaaatcacaattaatagctgcaccagagttttaaatatttatatttagtgtctatgctataaaaatgtattaataccaatttgaagtcttccagttcctttgggtcaataccatctggattccatatactcccatcagactcaccaacagcaatacatttagcaccaaaacgatgtaaatatctcatagagtgtaggcccacattaccaaatccctgtgaagaacaattacccataacacaaaaattaaagtcctggtatagacagcaagagtcatattttgaccaatgtaaatccatactctgtttatttagaagcaattctcaaaattcttttgccaaaagaaacaatgtactaactggtttctcttcaacaataaaattctctgtttaagaatgtgatgagcgggcatggtggctcacgcttgtaattccagcactttgggaggctgaggcaggtggatcacttgaggtcaggagttcgagatcagccatggccaacatggtgaaaccccgtctctactaaaaatacaaaaattaggcatggggtccgtgcctgtaatcccagctacttgggagaatgaggtaggagaatcacttgaacctgggaggtggaggttgcagtgagccgagactgcactccagcctgggcaatagggtgagactccatctcaatcaatcaataaatggcagtggtgttaagtacaccaccaggtcctcagtccttgatgatcagatgtcctatgttgtgaaaagggatgtcactaatttggagaaatacaatttttttttttttttgagaccgagtctcattctctcacacaggctggagtgcaatggcacaatcttggctcactgcagcctctgcctcccgggttcaagtgagtctcctgccttagtctcctgagtagttgggattacaggtgccgccatcatgcccagctaatttttctttctttttttttgagacagagtctggctctgtcacccaggctggagtgcagtggcgcaatctcggctcactgcaagctccacctcccgggttcaagtgattctcctgcgtcagcctccagagtagctgggactacaggcgtgtaccaccacaccctgctaattttcctatttttagcggagaccgggtttcaccatgttggccaggatggtcttgatctcttgacctcgtgatctgcccaccttggcctcccaaagtgatgggattacaggcgtgagccaccacgcccggcttaatttttctacttttagtagagacagggtttcaccatgttggccaggctggtctcgaactcctggcctcaagtgatccacccgtcttggcctcccaaagtgctgggaatacaggcatgagccactgtgtccagccaccacttctattttcaagtaatttcaacttaattaagattctcctaagtaaaatacatgttaacacatgaaacaaatttgggtcagtgtgtaaacctttctatatacttacaaaacttagaaaattatgttaagagacttgcccttctagctataatttcaagtttgaatactaaccaatattttggttgaatttggtgatagtttggttgaagttggtaacagtttcacatgtacttgagagatacttaaatcagttctagttacatgaatcataccaaggttcaaaaaacaaaatatctattactctgaaaaccaccactctaaaatttaagagatttgagataacttaattttaaaattacaattctaaaaacattgaaaactttacttaatgtctatcagttattaaggaaactttttttgtttttgtttttacctgaacaacaaatgttttatctccaaaccctggtgtcattcctaaaatgctcatgtaagaagcttcattgatgaaattttcaatcccatggaagacaccacggccagtagcagagatgcgtccatggattcccccttggctgatgggtttaccagtaacacaggcgtgtgcattaatatcctgtaagagggggtaattgaaagaatgaaatgtcaagtccaatttctctgttgaaggaacataatgaattaaagtcaaagcacattctcatttaatcaaaaatatgctaattaggagtgtgtgtatgaatgtatttaaggtatacttttaccaatagagacaagactcactttttcagctttctgttcctagaaaatacaataaaatatactatattttctgtttttttttttgtttgtttgtttgtttgtttttgagacggagtttcactcttgttgctcaggctggagtgcaatggtgagatcttggctcatcgcaacctccacctcccaggttcaagcgattctcctgcctcagcctcctgagtagctggtattccaggcacgtgccaccacgcccggctaattttgtgtttttagtagagatggggtttctccatgttggtcaggctggtctcaaactcctgacctcaagtgatctccctgccttggcctcccaaagtgctagaattacaagcgtgagccaccacgcccggcaaagtagaccatattttctgacagaaaaaacaagagtgtagggattgaacatcaagtaagtacaaataacatcacaaaagtagagctagctcagcctaaagctatcattccttcaacaagtatttaagcactactaaatcaaggtacatacacatcccattcatgagtgtcttaaaatctactataagacttgagcatgtcaccaaaacagagcctgagacaggaagaggctttacaattgtcttggatgggaagactcaatgttgtattctgccacttttgaaaaaggaagtttttaatataacttgatacttaatataacatgacattcaagttcatctaagagtagagtaacgaaagtatttaatgaagtatttttaaaaaggtatgtgtgggtaagagtcctgtgcttctgtgtgagcagagtatctttggtagcagtggttagctctgcaaagtggagatgggggttaacagtcttcaccatccatctttctgtcctctttctttgtcttttttttttttgagacggagtctcgctctgtcacccaggctggagtgcagtggcgcaatttcggctcactgcaagctccatctcccgggttcacgccattctcctgcctcagcctcccgatagctgggactacaggcacccaccatcacgcccggctaatttttttgtatttttagtagagatggggtatttagtagagtagagtatttttagtagagagtaacatcctgtgttagtcaggatggtctcgatctcctgacctcgtgatccacccgcctcggcctcccaaagtgctgggattacaggcgtgagccaccgcgcctggcctgtcctctttcaattgaagatgtgtgtatattcttgttcagaaacagaaacaggtgtaattagaaaaaagaagaattgggctaagtagggcttcccttccaagacatcaactatactataagcacggccacgagaacactgcagagtaaactcatcggtggagcaggagaaactagagacagtcttattttgtataggcaatcaatataaaatgaaaattcatataaaattttaagtcagtggcaaaagtataaaataataaatttgttgaagcaatttgctttccatgtaaacaaaataaaatgccctacttcacaccaaacccctaactcccaacatatccctaacattccagctggctgaattaaaaagtgatctgttctttatctgtattgtttaaatatttttacacagagaacttagaattatattatttgtgtaattaccaacaaaaaggatgaaagcaaggaagaaaaactcagtctagtagagtgattaatagaattagtagttttcccacagtttgctttcatgaataattaacacttatgaatacagaaatgcaaaccgagtgccaaatgcttttaaacagtgagaatgcaaatgctggagctgaaggaaatactgtctggggtcaggcctggcgccaactgccaggctccccagcatacgtaatggtcctgaaagcccagagaagaatacattctcccacctacactgcacttctaggtggggctaggacaaagagggcggcacgtttcagttcacatctagaaatgagtaacaaaaacaactgtgtccttcctttagggcttgattttagatttcttatcacttaaagagggaaaactgttcaccagtatagttgcttcacctgagtccagcctggtcaacatggtgaaacaccgtctctactaaaaatacaaaaaaattagctgggcatggtggcaggcacctgtaatcccagctacttgggaggctgaggcaggagaattgcttgaacccgggaggcggaggttgcggtgacctgagatcgggtgacagagtgagactccgtctcaaaaaaaaaaaaaaaaaaaaaaaaaaataccacacccagagctcattgctaaatgagctcctgatctcaggtgatccacctgcttccgcctcccaaagtgctgggattacaggcgtgagccactatgcccagctggtctcttgttctttttaagcaagacactatattgaatagtgcaaaccaatgggcagtatgttatttgtagctcattctcagtgctaacagcaagagaaagtcctgtgaagcacggccccttgaactatactggtgaacagttttccttcaagtgataagaaatctaaaatcaagggctaagggaaggatgcataaaaaggtgacaggtggaaaactgtccttttgggaagggcagttgaaaccacaattatttgaagggtctatatcgttcctgttttatttcagggggttgtataatttacctgatgtaatacctacagatatttattttctgatacttactaagggctatgtacagttctaggtgcattagattattattcatctaatgctcatgagtctcacaaagtaggtactattactactgtcattttgcataggaggaaatggaggcacagagactcccaagtcacagcactgatgggtgaaggtgccagggttggacttcaggtggtctgcccatgttcccagccacagcatgacatcacttcaggaaatgtccccatttccacattcttcctcttctccaaggcccatcttttcactatgaaaagaattccccaggccttcattcccctgggggacttcactacctctaccagcctgcatctcttcagcattgtctatctcttgcaccggtaaatctgtgtcttacagccaataaacatgccaaaagacaaaaaaaacctttttctctgggtaacagccacttttcaagctgtcttctttctgcttctctccggtgccatttttcttagttggaggctatatttcatgccctgcttccctcttcatatccccttgcagtccgggcccctgtagtagtctcctgccctcaagtcttcaaatgcacacttagctgagtcacacctgcttgaaaccagctctttgctgtttccctgtgttttcaggacaaagaccaaagttctcatggtcacctaccaagcagtaacctggcctgacccttttttctactggcctttcttatcccacctttctctttctcaactctggccacagtagtcagtccttatcctcccaagttcacccagcttctgaacttcagaaccttccctcaggtaattccttctgttccaaacacttgccactacccctaccctagtccatgtccacacacccgtctaagtgcagaccagaaggttttatctcctaggaggctttttctgaccttaccttgaaaggactgaaaggactggatgggcctgtgattctttttcatagcttcaaaacaacttctagcaatttatcccaattgtagtgaataccttgcttacacatggccctgcatgtagtaggcataaatgtattttttgactctgtttctcttcctactcctgaaatgtttcattttttaaggttgcacccctttcagggacaggagttaagtttcctctcatgttcagttctgtggtactacctctgctcagtccccagactcaggttctcctggttctctgtgactcagcctggtccctttccttaattccacatatatccaatccagttttgctgagtctctctgtcatgtgcctcacatgtgcaatgctcctctcctggtcctctggctcctggacttggtggaaaggcactgacaccataggaggttctctcctggcgccagcacagctggacactgctgccagcctattcttccccaggaaggatcagcaaaatttctccactgactaccatgtaaaacacaaacactggggcttggtgtttttgtcctggttcatttacctcttcattcttactttttttttgttttgagacagggtctcactctattgcccaggctggagtgctgtggtgcaaccacagctcactgcagcctcaacctcctgggctcaagcatgcctcccaggtagctgggattataggtgtataccaccacgcttggctaatttttgtattttttggaaagacagggtttccccatgttgtccaggctggtctcgaactcctgggctcaagtgatccacctgccttggccacccaaagtgctggaattatgggaatgagccactgcatccagccctcactcttactttctattacctttataaatatgccttaccttcagacaaactgaacgctattgtttctcttcctcttatcctccaaatctctaaatgttcatattctacccattttcaaggtctagcccaaatatctcctctagaaagtcttatttcagaattcataatctccactgttgtattacattatttccataccttatctgcttatgcaccttagttcctctttaaatggaagccctctgagggaaaaatcagaattggatgcttcttgatgtacgttctagtgtcttagcacagtgggctgccctggtcctgttccagtgacaagtatagggcagcatataagtaaagctcaatctgtgttcattacgatttaagaatagacaagtagacataaaataatatgcacatcaagattatgattgaatgagagaaaaacccagggattctcaacttttgatataatcagtcaaactgttaattcttgtagacagcaaatgcagaagcctcggggcttccagtgggtactcacatagtgccctatggtgctggcataggtatcagcgatccaggacatctcccgctcacctgtgctcatgtctggagcaggcacatcaatgccaggacctgcgggggcacagggaaagaggagtgcaccagtttttaagaaaaattcttctcgaacacaaagatccttgtaagtctctgtaataaccaagttaccatggctagaaaactttagatctcatttaggtagctaatcaaagtcatagaaatattcattaaatgtttcactataaaatgcagacacatacaacattacataataatttctccctctggcatttacttgctgtatgtttggaagttagctatgcacaacagatataagccactccataggatttctgagtgtgcgaccagaggttaatcagtttagcctctcttgacctcatttcactaacatgcaattagagataacagtaccattgtgttctatataagcaggattattatggttagggagttgacatgtatgagatagcagagtaacatgctgcttagtgggggtataagccctccttatcaagtagagaaaaaggggagaaggtcatattgctaaagcaattgtgttaagccccatattatttttacttgtggaagaatgtggctgtgacctattattcgacattcagcacatataaggttttaggccttagctttcagttcctcagatcataggaaattaaaggtttaggctaataaattagcttacaggcaataacaggaatcactgactatactactactgacggctacagtaagatctctgataaaaacatgttaagtgatgctcactcaaatctgtaaaggtgcagaaatactcctctcaaacacagtaaaaataaaaacaacctaattatcttgtatgccaattaaatgaaatatggtatacctatgcaaagtactaaacagccattaaaaagggtaacttatatccatgtaaattacttggaattatcatgaacatacatatggaaaaaggcaggtttcatacagcatgtataacatgttcccacttataatttttttctcttccctgccatatatatagtttataactttctatattatttcaactgtaaaatacaaactcgtttttacaaaacgaaaaacgcaacttaaaaaatggttaaactattaggctgagcacagtggcgcatgcctgtaatcccagcaccttgggaggctgaggagggcggatcacgaggtcaggagtttgagaccagcctgaccaacatggtgaaaccctgcctttactaaaaatacaaaaattagccgggcgtggtggcacatgtctgtaatcccagctactccggaggctgaggcaggagaatcgcttgaatggaggtggggggtgttgcagtgagccaagatcgcgccagtgcactctagcctgggcgacagagtaagactctgtttcaaaaaaaaaaaaaaaaaaagttaaactattaaactattatgtctccccataaaataattaaagttctaagggctgtacccaattattcctataaattttactttttagtcaacagaatcagtatattgtaatgtttttctataactcaggggcccaaggcctaaataataaacttttttgaacaagctgtgatgtaatggatacagggctagtataagataactttgaaatggtcaaggatcgctttttataccctgaccctctccacctcccacctaatctgtaactctatgtcttagcacccttcccttagtcaccttaaaaatctcatgaagtcaatgacgacaacaacaacaacaacaacaacaaaatcttgtgaagtctaatccccactgcacttggaaagattaatgccatattctagcctcatccactgacaaaagggctctctggcgctctccagctcctatttgctcactttccattcctttagtgacatacctctgctggaggtcagcacaactttgtttaaccactccttttctcccaatgtacaaatgacaaattggtcctgaatctttctagaggtaactacaaaaggattatgcttgctttaggattaaataagcttgttacctcaaacaacaattccaactaggccggggcagtggcttatgcctgtaatcccagcactttgggaggccgaggcaggaggatggcttgagtccaggaatttgagacaagcctgggcaacatagtgagatcctgtcttgattaaacaatacatttaaaaaacaaaaaaccggctgggcgcggtggctcacgcctgtaatcccagcactttgggaggccgaggtgggctgatcacgaggtcaagagagagagaccatcctggccaacgtggtaaaaccccgtctctactaaaaatacaaaaattagctgggggtggaggcacatgcccatagtcccagctactcgggaggctgaggcaggagaattgcttgaaccagggaggcagacgttgcagtgagccgagatcacgccactgagctccagcctggtgacagagcgagactctgtctcaaaatcaaaaaaacaaaaaacaattccaattggagaagggctctggcaagtggcaagtctgaaacacatggtttgtaaatcagaaacacgtaatgataaaatccttctcaaaaacagtctatacatgctaaacgtgaaacagcttctgccatccaaaacaaaatcacaaggtattagttattaggcttatgagttttctactccatacaaaactaatgtatagggatgcacagattacaagtagttcctgaggccgggtgcggtgctcatgcctgtaatcctagcactttgggaggccgaggtgagtggatcacaaggtcaggagatcgagaccatcctggctaacacagtgaaaccctgtctctactaaaaatacaaaaaattagccgggcgtggtggcgggcgcctgtagtcccagcttcttgggaggctgaggcaggagaatggcgtgaacccgggaggcggagcttgcagtgagctgagatcgtgccactacactccagcctgggtgacacagcaagactctgtctcaaaacaaaaacaaaaacaaaaaacaagtagttcctgaataacagatatattctttttgtttttttttaatttttatgttttgagaaggagttacactcttgctgcccaggctggagtacaatggcatgatctcggctcactgcaacctccgccttccaggttcaagcaattctcctgcctcagcctcctgagtagctgggattacaggtacctgcctggctaatttttttttatttttagtagagacggggttttaccatgttggccaggctggtctcgaactcctgacctcaggtgatccacccgcctcagcctcccaaagtgctgggattacaggcatgagccaccatgcttggcctaacagataaattcttatatagagaacaggtatgaggcagaagttaatcttttttaaaaaagcaacttttctaacagcatgtgactatagagtaggagatgaaagggtaattttggtacacagagatataaggggatgagaagggtggagacatcagggtcctgcagaacttaggtgatatttacactcacacaagagaatgaacattgacctttcaaaagcttttccaaaagcagaagaggaaggaacactcctcaactcattccatgaggctagaattgtcctgatacaaagactagacaaagacatcataagaaaactatagaccaatgtcacttacaatagcattaaaaggagtaaaatatttagttgtaagacttctatgtaagacttctacaatgagaactacaaaacatcattgaaagaaatcaagagacctaaataaatggaaagacatctcatattcagcattggaaggcttaatatggttaagatggcaatactggtcaggtgcagtggctcatgcctataatcccagaattttgggaagctgaggtgggaagactgcttgagctcaggagtttgagaccagtctgggatacgtgatgagaccgtgtctccacaaaaaattaaaaaattagctaggcacagttgcacacccctgtggttctagctacttgggagggtgaggtgagaggattgcttgagcccaggaggtcaaggttgcagtgactgctgtctggtactccagcctgggtgaaaggacaaaacctttttggggagggtggggaagatggcaatactccacaaattagtgtacagattcaatgaaattcctataaaaatcccagcctctttttttcttttgttttgcagaaatttacaagctgatgctaaacacacatgtgacaggatcagggttcaggctcaggtctgagcctcaatctgacactctctgtggaatgggcagtcaggaaataacagataaataacatcaaatttgaaggtttgccgaggagtgagagaaaaaactccctttgcctacctcctaggcttcaaagctttctgggccaagacgtcaatttaactgcatcctgggtcaatgaggcttttgcacattaagcaaataaatcaaattactagagtttaagctgtgttttctttcagtattccaatgaatcactttttgacctttggaattattaggtacttgtcaagtctgataaaattaagctggagatattgcagatatgggtgacaaatatgactgaataaagtctgaaaccattcaagactataaaatgtgtttgagatttaggggaagaggaaagaccttttaaaaattatgaaggctattaacaggctgaagatgacttcaattcaccatatctcagaatcagtaggcactcctataaaagtgtgagcgagatagttaactcatattaacttacgttaacagactccatgtaaggatgcacaagttcacagtagtgctgggtatgcggcacatcaaaggcccaaatgccttttattatcaaagacaggccaaatctagtcaagttttagagttacctatacttactgtatttctatattaggttatttcatgacatttatttcatgacttttttttcctaaaaatgaatccgaatagctttatttcatttctctttcttcttgagatgtggtctcgttttgttgctcaggccagagtgtggcaggccagagtgcagtggcacaatcatagctcactgcagcctcaaccccccaggcttaagggatcctcccatcttagtagttgggaccacaggcatgcaccatcacgcttggataatgttttcattttttgtagagatggggtcttgtaatattgcccagggtggtctcgaacttctgggctcaagtgatcctcccacctcagcctccaaaaatgctgggattacaagcaccagccaccatgcccagcctttatagtttaatttcatgggaacttgtgggggaaatgctaagaaaggaaagtagagaaaaatacactttattttctatttaagtagaccttattttgtttaactatactgatattgataggacaagtattctattattaagtaacaattaacattcttttttttttttttttttttttttttgagacggagtctcgctctgttgcccaggctggggtgtagtggcgtgatcttggctcactggaagctctgcttcccaggttcacaccattctcctgtctcagcctcctgagtagctgggactacaggcactcgcgaccacgcctggcaaattttttgtgtttttagtagagatgggattcctactaaaccccgttagccagaatggtctcgatctgacctcgtgatccacctgcctcggcctctcaaagtgctgggattacaggtgtgagccaccacgctcggcagtaagtattaacattctattaactatactgatagggcaagcattctattaagtagttatgcatattctattcaaacaaattagaagccttctagattaaaaaaaatataggtttaaactgcttgaaaattaaagggtacatgacaaatacttacatatcataaaaagaatattcagattgtgcacaaagaaaatataaacacagataatagtaagatacaaaaacatcaagcaaacaaagattaatatcttcagaaatgttgtatgtttggcaaaagctcctataacaaatagtaggaggccgggcacagtggctcctatctgtaataccagcagtttgggagtccgagatgggtggatcacctgatgtcaggagttcaagcccagcctgaccaacatggcaaagccccatctccagtaaaaatacaaaaatcagctgggtgtggtggcacatgcctgtaatctcagctacttgggaggctgagacaagagaattgcttgaacccaggaggcggacgagatcgcaccactgcactctagtctgggcaacagagtgagactccgtctcaaaaaaaaaaaaaaatttttagatgttcccactttataccaaaaactatgtggctacacataccaataaagcccttttttgctagctccatggtgaacctccttgtgatcttttccaattcattatcctgtaaaataagaaaacaaaaacaaaagaaaaaattgatataaaaatcgcttgagattatagctagcatcttattttctatttatagtacattttcatatgtcttctcatgtaatccttagaacaactcataaagtaggcattgccattttaaaggtgacaaaataagggatcaaaaaagtaggttataaaaacaagatagtagaactagggctcaaattcccattctattaattccccactgaaaaatacactaaatcttaattaagattaatttaaatataattatattccatttaaatggtgaattttaaagagaataaaaatcatgcatttatgtttgtatatagataatttagtattatgtaaagcattgtgacaatcagtttgaattaacttggaactgactggataaaaagtaaggtttttatagtcttagttaagatatgtgtcactagaatcagatcctgacataaaaacttcagatcacagtaatacttttttctttttgagacagagtcttgctctgttacccaggctggaatgcagtggtgaaatctcagccaacctctgcctcctgggttcaagcaattctcatgcctgagcctcccgagtagctgggattacaggtgtgcaccactatgcctggctaatcagatcacagtatttcttaaatatgggtataagtgtctaagtgaagacattatataaatatgggtataagtatataagtgaagatattaattacgttttaactaagtaagaaaataataaaacaaaaagcaaaaaagtaaaacaaaagactcataaaaacaaaaccaaatgaaacagaaaatgataaaggatatagatattaagtaggtgatctttatatggcaaaacacgctatgagttaattctttacatttttctattccatttgaaaagcaatggggactactgatctcactgatagtgggggatacagagaagcccagtaatttcaagtccttcataaatgcactgtgtgcacaaatgtcactttgaggccgggtgcggtggctcatgcctgcaatcctagcactctgggaggccaaggcaggtggatcacctgaggtcaggagttcaagaacagcctggccaacatggtgaaatcccctctctactaaaaatacaaaaattagtcgggcatggtggcgtgcacctgtaatcccagttactggatcaaggagaactgcttgaacccgggaggcggaggttgcagtgagccaagattgcgccattgtactccggcctgaacaacagaggaagactctgtctcagaaaaacaaaaacaacaacaacaataaaaaacaaatatcactttcatacttacagtatagttcttgggattgatcttaacaccagctttagcacccccaaacggcacatctgaaagagaaggctgatggttgctattccatataaatgttaaaaaagtaaaatgacagaaagcaccacacaatattagagaaacgtgatgctttaagcttgaatttctgaaaattcaagaaataaacctaccatcattttctaaactgtactttaaacaacattttgttgaacagaaattgttcaataaaattggctagccaagttctaatatatatttaatcagtgctctttaccacttctaaaagataatagcttatttactctccttctactataatttggtcttatttacagaatgtgttgaggaattgaaaacaaagatctagacttaaaatccaattatctcctattttaaaaaatcccccatgtaaaaaaaaaaggctatatcttaatttagactaattgaaaaatgatgcaggtcttaaagattacaacttgaaaaaaaatcagttctgataaggtatatttctacagcatcttaacagtaacatgtgtgtaaacatatttccccagagttctcattaggcagcaagaaaggcgatcacttaccaaccactgcacacttgtatgtcatcagagaagccaaagcttttacttcatctacactcacatcagtgctgtaacggatacctggtggtgtttttaaaaaaatgtgttggggtgggtgagaaagaaggggttatatttagaacaaacttaagtaagcttcaaaaaagaaagctacaaattgaaaatatccactttttacattttacatccaagctatgtccaaaaacacttgaagcagcttgtacatcagaacaccatgaaaaatgaatataaaacgttaaaaaaacctgctaataacagtaactatgatttcacaagacaaaaatcaccctgcaatgaatttctgtacactttccagaaggcttttttatgttccttttacctttggtttgggtgacctggttgcagggagttcaagaattcaggttgcttttttttgggggggtaggggtgggaaacagggtcttgctctgttgctcaggctgagtgtagtggcacagacatggcttactgtagcctcaacctcctaggctcaggtaatcctcccacctcagcctcctgagtagctgggaccacaagtgcacaccaccatgcccagctaatttttgaattttttgtagagacaggatctcaccatgttgctcaggctggtctcaaactcctgggctcaagtgatcctcccaccttggcttcccaaagtgctgggattacaggcatgagccactatgcctggcaagaattctgctttctgataattcacaaacatgggcaatgaataatcaccaggttcaaaataccgtatgtctaaacagaggttttggcttcaaatgggtatattaaaagagatccttacctgttattctcctcacccactgccaacctctttcaatctgaaaatgagaaagccattttccctttctgaggttgagtgattcccttcaccacttctgcaaagagggcaggtagccaagcagacaggtaggtactagtgcccctgtatctagtagccattacgtgttggtacagggtatactggaagtggggatgcccacagctttggctttgggggtcttggtcaattactcttcaaagttttggagtgctaatccacctttctttctctataatccattgcttctcaatcccaaggaggaaagtctgagtggggttgatgtttgactgcacagtgcttggggcactgggtgtttgtgtgtgaaggatacccacaagaagctgcagcattttttctaccctcccactcccaacagattcagcccctctcgaggggctgggtacgatttccactgggagtcacaagtaagtaatgggagccccagggagagctcttttaaagaattctgagattaaaagtttttcagatagaaaatatacaatatctcatggactggcagtttgagagaacttccctagtcaattttaaaagctagctttcttacatgtttctgaaaacatcaaccttaatattgataatgttttaagataatttatttattgtacacatgaccataaagagcatattctaagctgaacatacttatttggtctactgtacaaacaaatcatatttagaggagtatgtgcttagaactatatcttgtgtataactgattctcaaattgtgaaataaatgtagtcattattaaacttttggaatgcaaaattacaggtaatttttccagcacacagcagatatctgtatagctcactcccccatttcattcaggtctctgttaaaaacttcattctgagaggctccccttgaccactgtatttaaaagagcacctctttctcactcccactttcctgcctctcctaccttgtttcttcatatcgtttattattactgactttgcattatacatgtgtttattatctggcttccctacctggcaagttagcaccacgagggcagactttgttatgttcactgctttaattcctggttcctaacatagaaaatggcatatattaggcactcaaatacatgccgaattaatatacgaatattctgactcttaaaatttaaaaaagaaagaaaagctatggccacaaaaatatttgacatacatgttaagttttaaataacttaccataagcctccatacctatcatgaaaggactcaaagtatacaaaactgggaatgggggtgacggggagatgatggtcaaagggtacaaagcctcaattagaaggaataagtttcttcgagatagattgcacagcatggtgaatacagtaaataataatagattatacatttggcccaacatggtagttcatgcttgtaatcccaacactggaaggctgaggtgggaggatcacttgagcttaggagtttgaaaccagcctggccaacatagtgagacctcatttctacaacaacaacaaaaagtactgcacatttcaaaatcactgagtaaatttcagatgttttcaccagaaaaaatgataattatttgcaattgtttccagtggtgaacaggttaatcagcttgacttaattatgcaatgttgtattcataaatcataaaattactttgtacctcataaatatatatctacaatttgtcaatttaaaaaataaaaaatttaaaaagaatttccagtcagataaagcccacagaaaagggaaaaaaaaactgtaaataatattaagatgaatcatttgtatcttaaaaaaaaaaaaaaattgagttgggcgtgggggcatgtgcgtgtagtcgaagatgctcaggaggctggggcaggagagtcacttgagcccaggagttgcaggctgcagtgagctacgctcaggtcactgcactaaaccccagcaacagagccagacctttcctcaaaaaaaaaaagaaaaaagaaaaaaaaaattgtttaaacactaaaatgtgcttttcaaattattcaaaatgcttctaagtaataccacatattatttaatgataactacactaagccagggaaatggtaaggcgctgtgcccaggcgacccagcctgcaccatccgcttgcatggaggggtgctaatgccactctcctaggatgggtgtcacgactgcgaggaacatcgcacatggggaatctggcacggtgccctgcaagtggtcaaacaggcaaatctcaactattaccactgctataacaagtattacaaagtaatggcatgtaacaaagcaattaaaaagtctaaactgacaggagtttgaaaaaatgacttaataaaccttggtttcattacttctacataaattcacaggaaatagtaaaacaatgtattaattaagaactagtgctctccctctccctccccctccccctccccctctccctccccctctccctctccctctccccacggtctccctctccccacggtctccctctgatgccgagcggaagctggactgtactgctgccatcttagctcactgcaacctccctgcctgattctcctgcctcagcctgccgagtgcctgcgattgcaggcgcgcgccgccacgcctgactggttttcgtatttttttggtggagacgggatttcgctgtgttggccgggctggtctccagctcctaaccgcgagtgatccgccagcctaggcctccggaggtgccaggattgcagacggtgtctggttcactcagtgctcaatggtgcccaggctggagtgcagtggcgtgatctcggctcgctacaacctccacctcccagccgcctgccttggcctcccaaagtgcccagagtgcagcctctgcccagccgccaccccgtctaggaagtgaggagtgtctctgcctggccgcccatcgtctgagatgtgaggagcccctctgcctggctgcccagtctggaaagtgaggagcgtctctgccctgccgccatcccatctaggaagtgaggagcgcctcttcccagccgccatcccatctaggaagtgaggagcgtctctgcccggccgcccatcgtctgcgatgtggggagcgcctttgccccgccgccccgtctgggatgtgaggagcgcctctgcccggccgcgaccccgtctgggaggtgaggagcgtctctgcccagccgccccatctgagaagggaggagaccctctgcccggcaaccgccccgtctgagaagtgaggagcccctccgcctggcagccgccccgtctgaggagtgaggagcccctccgcctggcagccaccccatctgggaagtgaggagcctctccgcccggcagccgacctgtccgggagggaggtgggggggtcagccccccgcccggccagccgccccgtccgggaggtgaggggcgcctctgcccagccgcccctactgggaagtgaggagcccctctgcccagccagccgctccgagagggaggtgggggggtcagccccccgcccggccagccgccccgtccgggagggaggtggggggtcagccccccgcccggccagccgccccgtccgggagggaggtgggggggtcagccccccgcccggccagccgcctcttccgggaggtgagggggcgcctctgcccggccgcccctactgggaagtgaggagtccctctgcccggccagccgccccgtccaggagggaggtgggggggtcagccccccgcccggccagccgcctcttctgggaggtgagggggcgcctctgcctggctgcccctactgggaagtgaggagcccctctgcccggccagccaccccgtccgggagggaggtgggggggtcagccccccacccagccagccgccctgtccgggaggtgaggggcgcctctgcccggccgcccctactgggaagtgaggagcccctctgcccagccaccaccccatctgggaggtgtgcccaacagctcactgagaacgggccatgatgacaatggtggttttgtggaatagaaagcggggaaaggtggggaaaagattgagaaatcggatggttgccgtgtctgtgtggaaagaagtagacatgggagacttttcattttgttctgtactaagaaaaattcttctgccttgggatcctgttgatctgtgaccttaccccgcaaccctgtgctctctgtaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctgccaaatccccctctgtgagaaacacccaagaatgatcaatacaaaaaaaaaaaaaaaaagaaaaaaaaaagaactagtatttcttctcccacacataaatcactttttccattgctcttttagagcctgtggaagtcatcaccacattatttttaattttccttgctttcttaagtggaggaaatgttactttcttttaacttagaaacttaaaaattttaacttgcatttagtggggagctaaaaactgctggaaccaatgatattcataaatcaaacagaagcattcaaatggcaagcctaatattctagaaatagatgttattaaaaattagaaaccagacccctccttccacacaagtgtaaacaaaatgtccattttatcataagtcatggaatgacatgagtcagaaactgtgtgtgtataacaaaagacatgttccgctggatggaacccaggaattcttgtttgtaaagttaagttttctttcccagctacacccatttagagagctcaactgctaaacagtgaagagaagcagtttcacaaattacctctcacaccacaggcattttctgtaggctatgaaccaataaaggtttagtgaatggaagcacaggaggagctataaagaaagtaccagcttagtggaagaagccccagagccaacagaacagggacagggaggggatagaaatgaatgcaagtgatattgcctgggctaaagaagaaacattttcattttaaatttctagttaaccagtgattcatacatgtttttaattctagaaattggcaaatattgagtactgggctacctaaactggtagtctgaaaaacaaaaaattttaaagtgcacccattaataaaatactctgcagcaatacttgagacaaaacaatctccaataagacacaatgtacccacacacagaagaagccagttactcttccttctctgggtttggaaaccaaagataactatcaaaaatatactgtcacctgaaaataagtcttaactacattctaagggacacgaagagatttatgtaggggccagatgtggtggctcacgcctataatcccagcactttgggaggccgagctgggcagatcacttgaggtcaggagtttgagaccagcttggccaacatggtgaaaccccatctttactgaaaatacaaaaattagctgggcatggtggcacattcccgtagtcccatactcacaaggctaaggcggaggttacagagagctgagattgtaccactgcattccagcctgggcaacagtttgagactgtctcaaaaaaattaaaaaaaaaaaaaaaagtaagaatatgactgcaaaaaggaaggtactctacttaactcaatggattgggaaaaattagcacaactggagaatgtgaaggacaaaatgatgtgacatatacctcaaagttctgaaaggcagggaaagcctagcacttttgaatgcctactctcgttcaaatatactcaatttgaagttgttcaaaaaagtcaaataataggaaaatacatacacatacaagaaaatcagaaaatcttaaaatatttaagccaaaatgaagcaagaaggatcttatgtgatctgaatattgtcactttttataaaaccaagcctttcctccttcagcagagaaggctgaaggtgaacaggaccaacagagatcaaacaggggcacagaacagaaactagaaggaggaaggaagagatgttttattccagaaatggaggaaagtaaattatatttttgtatcccaaagtcttagacagttaggcatggtggctcatgcctgtagtcctagcacattgggaggctgaggcagaagaacttgagctcaggtgtttaagaccagcctggacaacatagtgagatcccatctctacacacacacacacacacacacgcacacaccgcatcttaaaactctgttagactccattgatgcattactagtgtttgggatcaactgggtctttggtcaactgtgctagtaggaatgaaggtaaatacttttaacaaagagcaggagtccacggctggctaagctagacagtgaatgggcttggtacacaggtgtcagccacagaactgatgccattagaaacatggcctaaaaatcaaggccaccctgctgacaaagtaatctgtgcactcagctcaccagaggaaactaaagacacaccacccatgacgtttattatttatcaatctcagtaaagctggaggaagggcaggggatagaatgacgtatgtactacaatgggaacttttaaatcattccttctattctgaacagaaactgactaaacagttattttatgttaactggtatccagatgtttccaaagaatattagtgaaatgcagacatctgcaactatatacagtacaaagcactgatctgatttttaacttaattaccacagatattccttagtatgctcaagtctaatgagcagtacatgctaagtttctctaggagaaataaaaatcaaaagcagaaactagcttaagttgctatagtgatgaagaaaacaaaccagctcattactttaaaaaagattcagtgaaaaccacaattgactaagcttgaattttttttccttttcctagctgactcaaaagcaaacacaaaagcctccagctagtcactgttttttataattagtcattaacaaaacatttatgaaaattcaagtggttttaaaattacttgaacctggttctcttaatagggtttgatttattcatcagaaatctaatttccagctgcactctctcacttttcaggaactatttattcagtaaccaagagttctaccagaagcacagaaccaccagaaaagcaaaaatgcctcagaacaactcttaatatttataagttaacactcttgccacttactcatcagattatattttttcacttaatattaatgtaccttctaacccacaataatgtagcgtaacttaatttaaaatgaagagaggaaggttagaagcagggaggaactctcaatgaccacccacaagtaatgaccacctgaaatactacgtctcagataaaaattcagacattcagcatgggaaggagcactgcatataggagctaagaaaaagtacacactttaggctgggcgtggtggctcacgcgtgtaatcccagcactttgggaggctgaggtgggcagatcatttgaggtaggagttcgagaccagcctggccaacatgatgaaaccctgtctctactaaacacacaacaaaattagctgggcgtggtggtgcacacctgtaatcccagctactggggaggctgaggcaggagaatcgcttaaacctgggagaccgaggttgcaatgagtggagattgcaccattgcacttcagcctgggcgacagagagtgagactccgtctccaaaaaaaaaaaaaaaaaccagaaaaattatactttaattgctttagcagcatcaatgtactgttttgtataaagtaggcaaataccatcttagatttttaatccagtctaaatcttttattttaacctgaataaattttgaagaggtaactaagctttctgggaagcaaatgtttagctgatattagaaaaatataacctattgacacatcaaagaaaaaacggaagaatacttttttcattaaaaatttaaaattataacacatatgtatgtatttctatcaaaatttaaatacaaaaagaaagctgaagactcccttgacttccacttatgaccccagtcttctccttaggggtgactattcttagcaatgtaagtgtatatccttccaaatcatgttccctgcaattatatatgtacatatccataaaacatacagctttgttttgtgttatttaacttacagcctgacagatggaagattatacattaaaagggggattttgttaatttttcttggtagattcttttattctgatcttgattaacagtaacttagctgcactttcacaccaaacaggtcttggaatcggaaatgatgctagttaaaatggtgaatataaagttggatttagtaaaaggtaacaataacttgttattaaaaagtttcaaagggataaaggcttgaaacctcagctatccagtttcatataaattatttacaagtctacgtgataatttgagatgggtcttaagagaggcagaggaatcctagggagggggaagtgaggcatggacaggcagagggactgcactattcaagggcatgatggagagaagtacgtgcctggatttccaatttccctaaggataattttacaccagatcttctttattttaaaaatccaatccttttccttaataaccccatctgtccctgataccaccatttttttctaccagtctctcaggctagaaattttgtggttatctttgcctcttctctccttcatcctgtaaatcctacctgttgggaatacattactgtcctttcttcaaaatgttttatctgtcttttctttttcattctctgctattaactataacttcattctcagttccactgctgcctagctttctgtgccctgctagattcatcattattcatccaacaaacataaaaggaaaaaattggcctggcgcggtggctcacgcctgtaatcccagcactttgggaggccgaggcgggcggatcatgaggtcaggagatcaagaccatcctggctaacatggtgaaaccccgtctccactaaaaatacaaaaaaaaaaaaaaattagccagcgtggcggtgggcgcctgtagtcccagctactcaggaggctgaggcaggagaatggcatcaacccaggaggcggagcttgcagtaagccaagatcgcgccactgcactccagcctgggagacagcgagactccgtctcaaagaaaaaaaaaaaaaaaaaaaggaaaaaattgttttttctcacacatttctgacaccaaatgtgtgggttttccacactaagcagttctccagttctctgcagatacaaactgggtgtcctgcaattcagttatgacactgactaccagggttagcacagaccccacagctcaagggctcagtcgcacaagactgttccctacttcagatgccagttccaagtcttgggtgcccagggcacccacacttctgtccaacttggctaccaaccagggggttcccatggccccctcctcaggttcaataatgttataaaggctcacaggactcagggaaacgttacttatgtaaaggatacaaatcaacagcaacatgaagaggtacacagggccatgtctggaatgtccccactgcaggagcttctgttcccctggaatttggagggtaccaccctacccatacatggatgcattcaccaacctggaagctctctgaactctccccatactccagccatcagttagggtttgtatagaggttccattatgagggcatgactgattgctgattaaactcaatcttcagcccctttccaatctccagaggtcaaagggtgggactgaaagttccaaatttctaattatggcttggtctttttggtgactagtccccaccttgaagctacccagaagcccattaagagtgtcctagttagaacaaaagatgctcctatcactcaggaatttgcgacattcaggagctctgtgttgggaaccaggcaaagagaccaaatatatttactgtcacaagcccttatttctcattatttacaaatgtagtttgtcctcatgacccccttacacacagttccacttcctgccttgggtgaagccaccccctctttatctgaaatggccttatccaactcctatccagccttctctgttcccacatcaagactgtctgtctgccaggcacggtggctcacgcctgtaatcccagcactttaggaggccgaggtgggctgatcacatgaggtcgggagttcgagaccagcctgaccaacatggcaaaaccctgtctctactaaatatacaaaaatcagctaggtgaggtggtgcatgcctgtaatcccagctacttggtaggctgaggcaggaaaattgcttgaacctggtaagcagaggttgtagtgagccaagatcgcgccactgtatgccagcctgggcaacaagagcaaaactctgtttcaaaaaaaaaacaaacaaaaaaacaaataaacaaacaagattgtccttggtttccttgaactcctactgcaacaacacatgatttactttgttttgtttttttttttgtcatttattgactggttctaggaaaggaaaatgtagaaatggaatactgagcttatagcaaaacaaaaaagacatagggtacaaaggagatttgaatctgctctacttgggagaaatcaatgaaaaaaaatattccaagaaataaaaaaattcaactttgtttttttaaaagaaccctctgcataaagttcagagatcttgcctgcaggaacaaaaaacacataatagaaaaattgatttacttagaatatagactatagttcataataaaagcagtccttatttggtaaaccttcaatacgagtacatcacccttggttatttctttgctctttctctcttggcataaaagaaaaaaaaaattcatgcaaaatcctactaaggcccaatatgtacaaaatatcttttaaaagtcctatgttgatatatttgtgataatgacaaacgataaaagaagtcatactactgacaacctttgaaattttcatttgtcatctttcacattttcctctagcctagaagcaaatcagaagaattacgtctgatagactttctccaagaataataatcaagagaaatagcaattcataataaacaaagcattttcttagtttttaatgaagaaaactaagaaagtaatttcaaaattattcaatagaaaatctttaaagataaatggactacacactggtagagaaatgagttgttctggctaacacattaatctcttaaacaccaaagtcttcaaacctcttttgatggaaaactgtttaaaatgttatttcaggtcttcggagttgggtgtaggggaaaaaggttatttcatttccttagcaattagaataaatggacctctagagatatcatctatgctgagttttatatgcaaagctgtttgaatatgtatttttctaggaagaaggtaggtcttctaatagcttttaacagaaatttcaaaggtatctatgatccaaagtattaggaagcattgtgtcaatggcatgaagtggttctcaatcagcgcttacaattaaaagcctaagatacaatttgtaactttttgcataaataaatcccagacaacaatgattaaggtgggtgctggaatcagatgcccagaatctgaacctcaactccactacgtactagctgtgtcaccctgccaaaggacacttcactcctcaaccttagtagccacatttggaaatcagggacaacagtgtattgcatgaggcataaaagcaatgatacatgaaaagttcttacatgcattgttgctataaggcatagaactgatgatgcatgaaaagttcttaataaaatgcctggcacacacagagctgaataaatgttagcctttgctaatatctgaccttggtgaaggcagttgacctcaagtgaaggcagaatgtgtgtggctgcagaatcttctaggtgtagttgcctttttgtaaagataatcggaaggtcttgagtagctccttctcctagtttgtcttcttgtccttaataaagcctttcctgcctttaacagtagtatttcacatattaacaattccgacttgatagtgaacacttgaatctgtattaatttctgcctctggaaaggggaaaatattgattcatttgaataactagtcagttttagacagcggcattagatttaagactgttcatggttatattgggggaaggacttggggtagagctgcttcacttttcattttgtaactttcgttactatttgattatgtgaatcatgcatgtgtattttatgggttgctgagtacaaaatttatgggctatttatgaatcaatgtgctctaaagtgatactagagatttttctctttattacttacattgtaaaagcctaattattgggtaaaataaatagaaaagaagaacagtcacgtggcagagactagtgtctaggattttttcaacatctacaggttagtattttagtttttaatggttacagaacccttagtatttttaacataagtaaataaaaaccgattttcctaagcactctgaattattaacagcggtaaacctaatttcttcccactatatgccaaaagttcaggctcaatttttatttcttgtacttaaacactacaagttgtactgaactttaatatatattggtgcttaggatccaatttttgatgccctaattcttacaaagtatactttggataatgagtgagcagctgtttgtcttcctgcacgtggggctttactgccaaaagcaaacttgctaaatggattcatacacgcaagtgacagaaagactgaaatctgatgtacagatcactaccattaccaagcgtcttcattttctagtatactttgggagaaaagacgcatttggcttccatgaaataaaaaggcataagggcaacacatttccgtatttaaataagatgtattaaaaacaacaacctcggggctaagtgcttttaaaagacacacaaattacctatcctctgactgaactttcagaaaagtcctaaattaaattcacctacaaaggttatattttatctgtggcagcagatgcagacacacagccacttaaaaatattagaaactgtgagtttattaaaagttacctaagttttgatggttgtcaattgagcacagcaaaataagtcagaaacattttttcccccagtgaaggcagagaaatatctcattttaaatcagtatcagtgctttctatagtcttcccttaagcgctaaacaatgacatcccagaggctgagggcgtctttaacactgcattgactccggtcttcccttgcattatgtcatcaagattccactgtttccttctggcattttgacttttaaaaactagttactggattaatatagggtacacttttttgggtactaatat

SEQ ID NO: 4 - DNA, 169325 bp, Homo sapiens
gcaacctctgcctcccaggttcaagcaattctcctgcctcccgagtagctgggactgcaggtgcatgccaccatgcccagctaatttttatatttttagtagagagggggttgcaccatgttggccaggatggtctcgatctcctgacctcgtgatccacctgcctcggcctcccaaagtgctgggattacaggcgtgaggcaccatgcccagacaaaaaatttgtttttttaaaagaatcggccggatgcagtggctcacgtctgtaatctcagtactttgggaggctgagacaggtggatcacctgagatcaggagtcgagaccagcctggccaacatggcgaaaccccatctctactaaaaatacaaaattagctgggcgtggtggtgtgtgcctataatccttgctactcgggaggctgaggcaggagaatcgcttgaaccctggagacagaggttgcagtgagccaaggtcgggacactgcactccagcctgggtgacagtgagactccatctcaaaaaacaaacaaaaaaatcgtagtaagaacacttaatataaacggcaactttatatccattgaatagcaaccccgatttctggtgctctgcatgtttagagaaacttctctagtagcaaactacagaaaagatccctgaatgtgtgggctttctaccatttatttttaacagcgagaacaaaggcatcaattcagccaatggtttcagaacctgttcttcttttttttttttctcactccatcatccagactggagtgcagtggtgccaacatggctcactgcagcctccacctctctggctccagcgatcctcccacctcagcctcctcagtagttgggactacaggtgtgtgccaccatgcctggctaatttttagtattttttgtagagaaggggtccgcctatgttgcgcaggcttgtctcaaactcctgggctcaagcaatcctccctccttagcctcctgaatagctgggactacaggtgtgtgccaccatgcccagctaatttttggtattttttgtaaagaaggggtctccctatgtcacctaggctggtctcaaactcctggctcaagcaatccgcctgccttagcttcccaaaatgctgggattacaggtgtgagccaccatgcccagcccattttcttttttaaggtggcattttttttagttttaatttttgtggatatatatatatatatattttaaatggggtacatattttgatacaggcatgcagttataataatcacatcacggaagctgggatatccaccccacaagcatttatcctttgtgttacaaacaatccaattctactcttttggttgtttagatgcttcattttctttgttcctttttttttttttgagacagaatctcactctgttgcccaggctggagtgcagtggcgcgatcttggctcactgcaacctctgcctcctgggttcaagagattctcttgcctcagcctctcaagtagctgggattacaggcgtgcgtcaccatgcccagccaatttttatatttttagtagagacggggtttcaccatgtcggccaggttggtcttgaactcctgacctcaggtgatctgcccaccttggcctcccaaagcgttgggattacaggcgtgagccactgcacttagctgagatgctgcattttcaatgccaacccctcaatccctgcccattgtgtgcactgagaccatcaagtgatttttttatatatccttcatgtagacctgcactggctagtacatacaatagctgcttggcatgtgtgactgtgtaaattctaaattagttaaaaataaataaaaatcaaaattcagtttctctgtttagccatatcaaatgctcaataaccacatgagattaggggctactgtgttggaacagggaagatacaggacattttcattttcactgaaagttctattagacagtgctggtgtagattctgacctgctcagctcagccttaagaacaaagtcttgagcctagcacggtggctcacgcctgtaatcccagcattttgggaggctgaggtgggaggatcacttaaacccaggattcgagatcagactgggcaatacagggaggccctgtctctacaaaaatacaaaaaaatcagctgaatgtggcagtatgcacctgtagtcccagctacctgggagactgaggtgggaggattgcttgagcccaggaggttgaggctgcagtgagctgtgatcacaccactgcactccagcctgggtgacagacagcaagactctgtctttaaaaaaaaaaaaaaaaaaaaaaaaaaaaaaaaaaaaaaaagatagcattttttacctcaaataatgacagaacgcagaatatttctcagcaataagaaaagccaccccaagaagcagcaaagagatgggctcacagtctctgaaaaggaagtcagtcattagccaccttctgacatcctagcaattagctggtcttgggagaagagcaggtatctccagagaggtgccaaataaataggataagagactataaaaatgaaaagccttttggcctttcatcacaggataatccaatgcatgcgaattaatggtgaaaggctcagtaatagcctttgtgaggaaataggagcagtgtagcaggatatcctttttccgcactaaagcacccaattctttcaattttatatacagcggaagcaattaattgtactagaaagaaatccacagctggcttttcctgatggcctcataagcaacaagcactattgttcagtttccgggacagatgtaaagtcattctattgcactgctgagatttttctgaatgtttagtttgacttctccaaagataacttatgtgttaacatctaaaatttgattcgtcttgtcatcacacattttcagtataagcaactgtcaaaaagttaatttttattgtgctattgcactccagcctgggcaacaagagtgaaactccatctcaaaaaaaaaaaaaaagttaatttttgatttgtaatataatccagcacgtgacttgatgctggtattttttccaaacgttatgtgactgaatcatgttattcacttttgtttgttttacatgtttacatgcagttgaactgcactgcctctgcttttgtggtatcatccacagtgtggctattcaggaatcaggcataacaagattatacatcaaaaactcagaaatttaacatttcaaatgctggcctgtatggcattgcttcaccttctagatgcattaaaatacaccatatttcattaattctcagatgcacattttttttgacatttgaaactttctggaattgcgatatcttaattaacgtgtcagggtttaactggcaaggtttttcttccttagttgtacataaaataatgatggatcttataatcaacagtatccatgctgttctttgggtggaaaaaacccacaacgaaacagtaccctagttttgatgacatatggtatacatagttaaaatctcatgagtatgatgtgttattgcaagtgtaacaacagaacaactctttatttattttttctgagacatggtctccctctgttgcccaggttggagtgcagtggcatgatcacagctcactgcaacctctgccttctgggcttaaggggtcctcttgcctcagcctcccgagtagctgggatgacaggcaagtgctaccatgcctggctaatttttgtaatttttatagagatggggttttgccatgttgccccggctggtctggaactcctggactcaagcgatctgcctgccttggcctcccaaagtgctaggattacaggggtgagccactgtgcctggcctagaataactctttttaccaagaaaaatattcacgtcaatcaaataaataaaaactttaattacatatcttatatgggattctaactgacttcattctgacaaatatacaatttgccactttcatttttctctctatcaatcaaccagttcttttaaataatatctactcttttttttttttggtgctgaaacccacagtcgaaaatatctacttttctgattataaaagtaacattgggccgggtacagtggctcacgcctgtaatctcagcactttgagaggccaaggcgggcggatcatgaggtcaggagttcaagatcagcctggccaacatggtgaaaccccgtctctactaaaaatacaaaaattagctgggtgtggtggcgcacacctgtagtcccagctactcaggaggctgaggcaggagaatcacttgaactcgggaggcagaggttgcagtgagccaagatcatatcattgcactccagcctgggcgacagagcagactctcaaaaaaaaaaaaaaaaaaaaaaaagtaacgtataacattgtccattgtgggggagataaagcttatggaagaaaataataaccatccattaggccaccacagaacactgccaacgttttctctttatttcaggataatctatttctttataaacacacatatttaataatacaaaattaacaaatgcttaaatatatcttgtcaaatgtcctgaaaggtatataatgttacacaataaaaaagcgggttctttaagcaagccagggaccagcctccccattgccactggagtagaattttctggtgttcgacaggatcacgtgcagatgttgcaatgcataattccagggagcaccattcgtgtcaggcaggttgcgaatggcacccccttaaagttgtgcaacctagcaaccctggtgctcagtaccgtgaccatagcgacagtggtacatacgcaggggagatagacaggagggaggatgcaacagcacagcagatgcatcaaggagtttgcaactacccaccaaccttcaaaacaatggattcgcagaagcaaggattcaataactggtaagctccagtggcctgggactgcttttttgatactacgtgtattttggtactccctaaactgtctccctcaggctgagaggcccctatttatgttgaagaacaaaggtatgaaaacttatttgtgagaaagacataagaacagctaagctatgtggaaagtcagtgatgtagaccattgagagaaaagcctaaggagatgaggatggagtagtcaaagatgacttcttggaagaggtggtactcaggcagtatagggaggagaatggcattaaatggagaatgaatatggtccattcttcagaaagtagtgagaccagtctaacgaaatgttactctatagcagtgttttcagatttaatgggactggtgtttcacaatagaaatctaaacaactgggcaacattagttgaaagagggaatgaccaattaggaggagagctagcagcattcaggatcggaggaagaggggctttaaggtaggtagcaaactaaatggaaactaatctgcattttaaaataaacactgacaagtattggttactggttatatatatgactatgtatgcctttgaaataataaaggaagttgttttaaagtttatttattgagaacaagttgttagatgatagttctgttattatgatgtacaggatttgttagtagactctcattccaacaagataagtgctttatcattaatcctcaaaaatatggaaaaacaaaacaaaacaaaacacctaaccctgccttggctaatagaaataaaaagaaatgcgccagggcaaactaccagtagagaacaaaattaagtatgtcattcatttaataaatacttactgactacctactggtgtgccaagcagcacactggatacaatggagtgagaatgagacagttcccattctctgaacttttgagtccagcacagggtcaggtactttcaacatatccgatgggtaaactagtatgcctggtcacactggtgacaccacaccacatctaggaatacatcccaattaccatgtaagccatggacagtaggcacagtatggtgttcatgaatctgcactcctgatccagattttatctccccagttatctcagcttgaatcttttatcatcgcaccttgccttccttttactagtcattcccaaggtaatcatattcagctccacatgctggatttctggactactagctccaaaggaattcttgagtagaatcagtgtttagggatactaagaagaatcagacatgggtcttttcatttttgaatgtatgtatgggttttttgtgtgtatacacacaaacatatgtacatgcatacgtacatatatgtacatatgtgtacatgcatacttacatatgcacacatatgcacgcatacacatgtgcacatatgcgtgcgcacatgcacatgtgcgcacatacgcatatatgcacgtgtgcacatacgcatatgcgcacgtgtgcgcacatacgcatatgcgcacatatgtgtgcacacatacgcatatgcgcacatatgtgtgcacacatacgcatatgcgcacatatgtgtgcacacatatgcatatttgtgtgtacatatatacatatatgcatatacttacatatgtacacaaacacctacacacacacacaaagttcagactagaaatctatttgaattatattcaatagattatatacacacacacccctattacacttggattaatttttagccagaaaaaaatatatatatagcttttttttttttgaaacagagtgtcgctctgttgcccgggctggagtgcaatggcgagatctgggctcactgcgacaagcgattctcctgcctcagcctcccaagtagctgggactacaggtgcctgctgccacatccagctaatttttgtatttttagtagacacagggtttcaccatgttggccaggctggtcttgaactcctgacctcaaatgatccacccaccttggcctcccaaagtgcttgggattactagcataagccaccacgcccagccaaaattacatataatacacctttaatatgtacttagtgtatgtccagagcatatatattatatatagttttcatctggttaaaaaataatccaagtgcaataaaccaggtgctgtgaggatagggaaaagcagggcagtgagctgcagcaggacagggaaggccaagatctactgtgggctgcgtgggagttggggtagggaggccccagctcccggtgctcggtgggaggaaccatagtcctctaggcagtgcctgatagccagagagtagtgagcaaacaacaggtggtagtccaggagcgcagtggggatggggacatccagcctgaggtaatgggggaagggaggcccaacagatagatagaatacagatacagggagcctagaaacaaagagctggaggcaattaagtgatgccaccaacaatacctacaactgcccagcagtctgggtgcagggatgcagctaagtccaaacaacaagcagagaaattccaggtcctggcaagctaacaggtcagggtttcagacacaagagaagggctgtcagttcttagaaaggggcgaggcagtgggaggctgagtcttgagcttgggaccaaagctctgataattcttcctgcctcaaggcctaggaaagatcaggttctatggtaaagggtgtacggatagtagggaaaggaggaatacagaggccacggactaggtaggaccaagtgagagcagcaatatcctccatcatctatctttcaatcatagtagccagtgctttgaggcaaagataaattaaaatggagctaagggagaaggagcaagttgtttagaagtaaacaaaagaagtaaaacactgtaccaccacaatgaaaatgaattcaggtttttaaacttcctctattttgtgcactgaattatatacatccatcttattcttaaccacagtttctgtttcagtttagtccttctaagccatgatggggtactactaaccaaaaaaaaaaaaaaaaaaaaaaaagatgtagtagtgtccatgctgaaaaatgaagctgtttattctccctaacacctacccatttaatattgggtttgaagccaacctaaagggtcaccctaccaatggcattccttcactcgtgcctccttactggcctctaacttatcatcagacccagagacttcgtgctgccttttgccttataagatctttacaacatgaaaatgactttgaatggattagcttggattaatctattcaccttggatccctgaaggcagaagtcccatttcactgaagaggatgtgatccacagctttcccagccaaccttcactctttccaagatagccatgccaccctctaacactaaaagggtcttggtgacaaggtttagaaatgcctagaggatatgtatgcttatttctcttctctcatttaacaaatattcacttgccaggcactaggctctgaggagagagttgagaatagattgacaaagtcaagctggcctgtagtcccagctacttgggcggctgaggggggaggatcacgtgagcccaggagttccaggttacagtgaactatgactatgccgctgcactccagcctgggtgacaaagtgagaacctgtctctaaaaaaagagagactgacaaagtcttttgctcatggagtttatattctagtggagcagaggggctcagaccacaaacaaataactaaatgcacgatgtaattaatgaatgctgctttgggcatgtaacaactacctctcttgtgacctacctggacagaagaaaagaccatttccagcctattctagtaacccacttaaaggaataccaacacattacggaatgttaactgtggatcccgagatgttgcttttgagtttgggggccagaacacacgtgtccagatgtctccctgggcagacagaccggagaaacgggctggcatgcataaacatgccagtagccagggagaacagcatgccccactagctgctggtagccagggcgctgaggattgaagcctgggtactagctgggccttatcaaaggagagcgaaaaattcctgaagatttgaaaaggagagtcttttgcagagaagcaaacatatcacgacttaaaatttgatgcttcaattttgctctcatttctacagtggcagataacacaagccagggaatactcatttgtacatttcagaaacttgatgtactaaggttcccacctgagattgttgtctattttatagaccaattcatatgtctaaaaatccaactagactataaagagcataataacacgcttgccatggttttctctgccgacacattgctcagcatacgtcaatgagagctttgaccaatcaatgtgaatctccttaagcaaaaggcccatcttttcctttagaactaaagctggggctgggcgcagtggctcacgcttgtaatcccagcactttgggaggccgaggcgggaggatcacgaggtcaggagatcgagaacacctattaacacggtgacaccccgtctgtactaaaaatacaaaaagttagccgggcgtggtggcgggcgcctgtagtcccagctgctcaggaggctgaggcaggagaatggcgtgaacccaggaggcggagcttgcagtgagccgagatggcgccactgcacttcagcctgggcgacagagcgagactccgtctcaaaaaaaaaagaacaaaaaaaccccaaaaaacaaaaaaactaaaactgggtattatgaaggaaacttgagaaagaaaagtgaccaattttagttgatgcaagtaatctcacgtatcctcttcttcctgcatagcaagatactacaacccatgactgtcaaacctgagacagctgaagagcccagaaaaaaagattagggaagaaaacagaattgaaaaataattcagaatgacagaggctatctgcagcattaagggcaaaggcgggtaaaagaagaaaagggagacagaataaaagataaaccaaaaaattgaaacaaaatacacgggaattcaaacatttataccagaatataagggaataccctggaatctaaacacctcttcaggcaagaatgtgtgtcaatacaaatgcctggcacattgttttccttccccctttctttttacccagtttacccagttttaaaagtgattttttaaaatgcacctttaaaagaacatcttttgttaagtgacttaaacttgatacatttcttggattactaaggaggttaaagtcacatttggtgaaaaaggggcctatctcctctttcctcacatacgggtcatcgaatacttttaaaagcattttccaccatgaatgaggggaaatggaagaaaagaggtggtgacaattatttgcattttccaaatggacggaatgagcctccggagggtacacgaggtcaccagcgtgagcccgcggtggagctggaggcgtatttatagctggctgacctcagtcctgttgggccctcgccgctccttatcttatgccgctggaattcgcgggctcgcaggtcacaggagcccgggcgcgccgggcctggcgctcccgaatcgatgagggaagccgctctccccggcagatcctcccggccggggagcctccatcaccctgcctgcgcctcggcacgctggcaaggagcccgggaagagacgccgggagcggtgggtgggcgagaaacaaatgcaatgtgacttatatttttctttgtcgcaactaccacgacctggccatcccccaccttggtgacttggtgccttcccagcgaccttatttcacgccagctgactggcgttcaccgcagtgtgagtgtcggccggaggaggggtccacgcgaaagagcccgcgagagtggggatatccggccccgaaggccggagcgggcgtccagggcgccgatggccgcagcgcccggcagccgtgtccacgctcccctccgccgcgttccatcgcgtgctacctacggcgtctgcgggaagctacccgggcggcagctgtggggctggcttgtggggaggggccggcgggcccgcgcggaggagcagccccgactcccgcccgcaccagcagctcggcgcccccttgccggcggctggccctcctccccggcaactgggcgccgggctccgcgaactcttcgggcgcttccgccgtgcgctcggctcttttcgtgtccggggcggggcggggcaggcgcccgtggtcgggtgcgcgcggcgcgggcgggggccttcccagtgcgcgcgcgccgtgcaaggcccgcggacgcccgcccctcccccaggcccccgcacccgcgccgccccctcccctcctggcaagagtcggcggcggtggcggcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccgggtgagttgggagtgcgcgtgcggaccggaggggctggccgcagcggggaggccagaggggctcgggcgaggctgcagaggcagctgggcgcgcggtggccggagccaggggctgcccggcccggccccggcagctccgcaggcctcggcgcgcgctgggccgggaccgcccagccagagacccacggcaccccgcgccgcgtcccccgccggcccctcttttgtctcccactcgcgggttgcaggccgagtttggggatgcggagtgggcgaaagtcgctccggggacgcttctggaatccttaaatgggaaaggcgctcacctccccgccccggagcggcgaggctgatatttgtgatttggctccggacgctgtggggaggaacaggggagaacaaaatgagtttcgggcgggggtcgagtgagaggagcagccggcccgcccccgagtccccgcgggaaggggccctggcccccgagctcccggagctgcttcacctgttgtcctgcgcggcctccgctccgtggcctggtgattccgtacttcagttttggaaaactttctgctggattgcctggacccttttttctctttccagactcctagtggaaagatttggcaaggaaaaaaaaatgagcttgcgtcagggaagaaaaataatatgctgtgtgttagggtctggcgtttgagcgtggtactctttcatgctctcagatgttttaatttggtcaaactcctgcaggttttctcttttaagcggttaacaaactgttcagagtacatagtatgaacttggcacctgtgttacgtcatttaatccttacaacgattctggtttattgtattcctcattgttttaggggaagaaaccgagtcgcaaagaggttaactaacttgtctaagggagctgggatttgaacccaggaacatcgtattctggcaaacgaattaggaagaaaaaaaaccaaaactgtttgcaaacacttttacgtttaggaacatttttcagttactcttacttgaaattatcgctattttgttgctggagttgaaaacaactactttattgtatttacttgtgagaggagttaaactttgaattagagtgtaacttaatgcgtctcattgttttcagttgttgaaataaagaatgtgaaccagaattatttagatttttaaatttgaagctaaaatatgggcaattctctgatctaggaatggggtgagtgtatgaaaggccgattgaaatgtagaatgcgtttttagtagaaccagactcagttcttgtttaatttttcctccattttccgtggagcccactttaaactttttctactttcttcacttctccccaccctttacagaagaggttgaggcacttagcaggagctccttcattaaattccttctgttactggcttcttaaccttccgtcaaagagggagaatttttttttttttttttgtctttcttattagttaacaccttggggtttttttcctttccttctaattttcctgcttagtggagcgtgagttattttctctgtcgtatttgggttctttaaagtacaaatgttcttaagattttttcagtttacaaaaaccttttcttaagtctgctactccttcaagctgtcttgttgctgcttttccttttcaaatcttattaacattttaaaaagcttgttcgtaataaaagtaacacatggttgttaattgcgaactagcgcaacattgaaattaaaatttagtcattcacaatccatctctagagattgccaagtgtagtctgcttttcctgcctttgcctggttggtggctagccactcatttcttaaccccttgttatctggatttcaccttcacaaggaactataacctaatcaacacatttaactacctttttctaagtcctctccttgagttttctgtaagatttaacatcgacttcacattttcagatgcctctccttgggtttcattcatctatactcgctgtattctaacacagggtccaaggcagtaagatacaacagatccttccctcatggagcttaaagtctagtggggaaatacttattgaaaaataaagtctctagttaaatataattgtgattttaattaaggtgcagaatattataagaacttcaaatggagacctgatctggtgcttgtggtggtgggagaatctgggaaagataccttaaaattgctttgttggaacccaggcagattgtgaaggatgagcaagagttaactattaactagatgaagaggggccttttgtgacattatactgactttgttcctctccgccacttttctgccttctgtttcttctttcctctttaatatgcgttctccaagtttcacttttcagatcacttttctctatgtctctagtcccttagaatgattgttcagacctttctgttggaataattctcaattctttgtttatgtgtcttctgaatcacgtttttttgtttgtttgttttgttttttcttttttattcagttgctttctacatatctgtacctgattgttctgagctgcttttccttagcaaacttgcctctttggtgttctttatttttgttgatgtcataccaaacccaaaccttttcccatttcatcatatcttgtctgtagccaacatctgttgattctgctttatgatattgtaactcttctgctctctattcttgctaactgtggggcaattctgaattcatattggtgtgaaggtagtagtcaaatcataaaacgagttgggcagctttccttctttttctctttttcaggatcattttagactgggattatctgttccttgaaagtttggaagacctcccctatgtgaccatttaggcctagatcttttttctggagaggactttgagtaacacttcaatttctttaatagctgttggtttgtgtcgattttctgattctcatatgaattttaatgtttcacatttttttcaggaatttattttcaaatctagtgttatttggctttcacgtagttctccccccaccaccccgcgactccacccccaccccctaactctaaatcaagttctcatcccacctggactaatgttatgattttcttgccttcacttttctcctttatctaatcttatgtatttctgcctaaattaatctgtaagcccagttcttaccacttcgccactcagaagtttcctaggtcttccattaaatgaaatattttctgtggtatttgcctcagatttacctgtttttttttttttttttttttaataccttattgttttttctttctttctttctttctttctttttttttttttttttttttttgatacagagtctcgcactgtcgcctgggctggagtgcaatggcgtgagctcagctcattgcaacctctgcctcctgggttcaagggattctcctgcctcagcctcccaggtagctgggaccacgcctggctaatttttgtatttttagtagaggtggggttttgccatgttggccaggctggtcttaaactcctgacctcagttgatccgctcgcctcagcctccctgtgctggggttacacaggtgaggcactgtggctggcctttatagcagtttttatacaaatattagtttcactactagtttgcagggtgggtctgtaacggacttttcttgcatattaaaaggaataaatggggaaaggctcctgtctagcctaacagtagctgttgaactgtcctgatctgactattggatcttaggagcagcgaaccatggagagaaaggaaaatgggtttcctatcacactaaattttgaagtaggaaccatttcttttccttttctactttcccaccttttactagtttttaggctttaggatgtctttttaacatcacaaggtccatattgaccaagttggaccaactttttaacacaagattaaatgttgacttgcattgagttatgtccattgtaagatacacagtagtgttacagaccacttaaaatatgcttctagttgtaagaagccattgattgtaaggtgcaccccaattccggagatgctaaaatatgaaaaatggatgcatcttagaattgatgaatagtgtttctctccctaatcaaagctcttggatgtgcctggaaatccccagtagtgttttttgaaaagaacactagttaggggcatagggagatcagatgatcagtagactccatctcagggtggcccctgtggtccctaagccagttcgtatgggcagtttaatatataactaatgagtagacattgaatagatgagtaaattatctttgagtatcttttatttactctgatgttgtagactttgttactcttttatagttttatatttctgatgagccttcctttcttatggcacagatttgttatactgttaaagtctggaacagtggagcttggctcttgatccagctgtatataattggctgttgacttatgaaggaggacaggagtatgctagagatagggataaaatattataatcacatttgcagttagggagattagttacatgttggaaaatcattttgaagaaaggaagactgaagatgttcaaacttgtaggaaggtctttctggcctagcccggattaaacccatttatgcctagtgttccactattggaacgctaagcacgtgggagttatttatatcctgctcaaggtcatcaccaaggtctgattgcaaaaattcaaaaaattgcagcctcaggcataaatgggttaagatggtggcagataattagggcctggaatggataggaggcgataactagcgtggatgagagaaggaatgggattggcaagaacaactcctggatttctagcttggaaagcagggtagatgtgggtgacagatatgaaaaatgaggtgggagagctggtttgtagaagaaaatagtattggatcacatggagtttgagatatctgaaacagccaagtagggatttccacttggcagttgtctatatgggtctggggtttgacagaggtttgtgctggaggtaggcatttgggagtcattgctgtatagattttatattccaacagtgggaattgggtggctctctcaagtgactcttgcttacaagtgacagccctaactcaagttagcttaaaggagggaaaagcttctccccactaacccccatgatattgaaaggtctagaaatagacatggctggacctaagtgctcaaatgatataattaattgaggttgtcttttctgttcttcacttttgtggtctcatttcaggcaggtgcatatatctggcagaggaagacataggttataggttatagaattacaggttataggttatagacctcgtatcgagaactccttgtatggtctagcaaagagcctaaaacagcattgagaattttttttctttctttttgagacggagtcttgctatgtttcccaggctggagtgcagtggtgcgatctgggctcactgcaacctccgcctcctgggttcaagtgattatcctggctcagcttcccgagtagctgggtttaacaggcgcccgccaatacgcctggctcctttttgtatttttagtagagacagggttttgcctcgtgggccaggctggtctcaactcctgacctcaggtgatccttccgccttggcctcccaaagttctgggattacaggtgtgagccactgcgcctggccagtcttgagaaatttcaacttaaggcctgggtagagaagatagacattaaataattatctagttgtagttatgttaagatctacaaaaaggaagtccagggaatgttacaagactgataagggaagctgggctgttcaggatgcgggtactttggaaggctttcctgagaaaggtagcccgcagagtgagaccttaggcaagaaaggacaaggagactgtttttggaagtattcagtagtatttatttatttatttgagacggagtctcactctgtcgcccaggctggagtgcagtggcgtgatcttggctcactgcaacctctacctcccgggttaagcgattctcatgcctcagcctcccaagtagttggggtcacaagcgtgagccaccacgcctggctaatttttgtatttttagtagagacggggtttcgctgtgttggtcaggctgatctcgaactcctgacctcgtgatccgcccacctcggcctcccaaagtgctgggattacaggcatgagccactgcgcccggccagaagtattcggtaaagtgagcagtttttgcagctttttaaaaattttaaaggcaatacatctattgtgggtaatttgggaagtataaaaagccataaagaagcagcggaatgattaagtttcagcttctaattttttataaataatgtctgatactggttttactactgagtacctattcaatcacggatgccacactaacccaatccgaatcttcgtttctttatcttaaaaaatagaaggaacatggtgaactttaagataatttttctgcttaaaaaaagaaaaagaaagaaaatatcttgacttgcagcacagttagctgccgaaattgaaggtcatataatgcttttggtcctaatgacatcactggacttctgacttttggctgaagaatcacgccagccttggcagtccttgcaagtaccaaagggagtatggcttatgcctgcggtgcccttcccgtatcctgctttcttacctccttttttgagcattaatttttttttctttagcctttgggtaaagtatcaaaatgttgagaagatagactctcaattttgaaggtgagaaatctgtaggagacttggatagttgtttttttttttttttttttgagacggagtctcgctctgtcgcccaggctggagtgcagtggcgcatgttggctcactgcaagctctgcctcccgggttcacgccattctcctgcctcagcctcctgagtagctgggaccacaggagcccgccaccacgcctagctaattttttctattttttagtagagacagggtttcaccgtgttagccaggatggtctcaatctcctgacctcgtgatcctcccgcctcagcctcccaaagtgctgggattacaggcgtgagccaccacatctggctgacttggatagttttgatactgttttatgtatattaagatttgtaggtagttttcttactagtaattaaaatgctttgtaatgtatttcaagagtatagggtcttgagtgttttaaatttgtatataagaatgttttagattcctggctaaaagaagctcttgttagaaaatattaaagtaaaggctgttaaattttggtgaggctcttaatgtctgcatttttcaagaatcatttaaaaatgtcatgaaataaaaatatttcagtggtaactgttcagaagtatcttaaatgtataccaaatcaatgaaatataatcgctgggtgacagattattcttccttcattttataatcttttatttaataaaaatgtgggggaaaaattgcatgttgaagttgtacgtgtatattttagcaaaaactgttaatctttctgaagtactgctttggtcatcatccctatttgttaaatatttttccctgttttcttatttgcttacaatagaaaatccagaatatcttggactggtctcctgctctggccaagtcagccttttctgctttgcttcctttcctactattttatcagcctaagtcacgtaaatatccgattcaggtttgggttcagaatccttagacctctactgtccactacaatagatagccactaccacatgtggctgttgaagacttgaactgtggctagtctaagtgtgaattacgtaccagattttgaagatagtaccaaaagatgtaaaatatctcattatgcttttaaaatattggttatatagtgagatgatactgttagggatacattggattaaagaaatatattaaaactgattttggccgggcatggtggctcatgcctgtaatcccagcactgtgggaggattgcttgagcccagcagcttgagaccagcctgggtaacgtggtgagaccttgtctcagttaaaaaaacaaaactgatttcacaggattctttttactttttaaatgtggcaactagaaagtttaaaattacacgtcatattggacagtactgcctttgactttcctttccctggttctttgcccatcagaatgctttaaaatctagtataaatccttggccaggtgctgtggctcacgcctgtaatcccagcactttgggaggccgaggcgggaggatcacgaggtcaggaactcgagaccagcctgaccaacatggtgaaaccccatctccactaaaaatacaaaaattagccgggtgtggtggcacgcctgtaatcccaggtactcaggaggctaagacaggagaatcacttgaacctgggaggtggaggttgcagtgagccgagattgcaccattgcactccagcctgggcgacagagtaagactctgtctcaaaaaaaaaaaaaaaaaaaaaagaatattcctctctctcctatgaagccctcctcagtggtccaagcctcatagttggctctttgctgcatcattatttgaagataatcttttggtatattagatttctttactacaaaccttctcagaacttttaatatgctaatacacatggtgaaactctagtatagtttccctaactacgtattaccatagaactgtgtgttttctgttaacagaagttacacatatttgtggttgaaatttcaaacaatacagaaatgaagtaatgaaagtcttctgtaatcatgcttcacctgtgccccaagattgccactgttgaaagtatagagctagaaaaaattttcttttctgttgccttctttctttttttctgtccccatttcctaaaatggggtcatacgatacatccttatctttaaatttattttcactgaatatatagggggattctttttatgtcagtaaatttcaatttcctcattcttttttttttttttgagggaaggtcttgttctgttgcccaggctgcagtggtgctgtggtgcaaacagctcactgcagcatccaactcctgggctcaagcaatcctcccatctcagcctcctgaatagctgggaccagaggtgcatgctaccatgcccagctaattaaaaaatttttgtgtgtgtggaggtgggatctcaccatgatgcctaggctggtctcgaactcctgggctaaagtgatcctcccacctaggcctcccaaagtgctgagattacaggtgtgaggtgttgtgcgcagccttaatcatctcattctttatagtagttaagcagttattccattttctgattataccttaattttacttaccagtttcgtgttaatgaataattagattatttccatttttttcttttgcattgcaaatatgctgtggtgtttgtacatatcctttgagactgtttttattttatgaaatgaattcttagaaatgcatttactataagagaagccgtgcagattggatggaaagtgccaagccaccctgcaaaatcttcgtaaccattcatattccagccaacagtatttgaatatgttctctcctcccaacataatcatatcagtcttttttttttttttttgagacggagtctcgctctttcacccaggcgggagtgcagtggcgctatctctgctcacagcaagctccgcctcctgggttcatgccattctcctgcctcagcctcccgagtacaggcgcccgccatcacacctggctaatttttttttgtatttttagtggagacggggtttcaccgtgttagccaggatggttttttttttttttttggagaccgagtcttgctctgctgccaggctggagtgcagtggtgccatcctggctcactgcagcctctgcctcccggattcaagtgattctcctgactcagcctccggagtagctcagacaacaggtgcacgtcaccatgtccagctaatttttgtatttttagtagagacagggtttcaccatgttggtcaggatggtcttgatctcgtgacctcgtgatccgcccgccttggcctcccaaagtgctgggattacaggcgtgaggcaccacgcccggccatatcagtctgtttttatctttgccagtttgccagctgaaaaaacattcatgatataaggtttctttgctgttgtatgaatattaaaaaacaaaaaattttaagtttcatttgtcttatactctcaacttgttatacgctcctttgatttttgtgctaaaatatttcgtattgctaacagtacacatgcatgctttgtacaaagtaaatgttcagatatttgtatctgttcatggcaaaggcgtccagaatatgctactgcaacataaaaattatttggaaacctggtggctcatgcttgtaatcccagcactttgggtggcggaggcaggaggatcacttgagcctaggagctctagaccagcctgggcaatatgttgagactctgtctctacaaaaatttaaaaatcaatgagatgtggtggtatgcacttgtagtctcagcaactcaggaagctgaggtggggggatcgcttgagcccaggagttcgagactgcagtgagccatgatcttacactgcactccagcctgagtgacaaagcaagaccctgtctcaaacaaacaaaacatatattttaatctggaaacatttgagaatagcttttttttcctcctgaactcccttgtctgcctaaaactagatcctcccccaaagaactcaattgtcataacttccagttgtcataaatcccttccttgggagttttgcaagcagggaagatggtctcttgtcgctggagagaatttggcaccacacctaaacagacattgttataaactatcctatgtccaactgttgtcctaagggtccatttgtctttcctacatgttacttgttttcctgcaacagcccattgttcttttctagttccagttcccctagtaagatggtacacatgccccaaattcggacagcccccttgggtcacatttttctgtgaattattctacatatgtgaatcaaatctgtcatttctcttgcagatgtgttctttgtcagtttaatttatcagacctcaattactgaacctaagagggtgtaggaagtttttcttctctgacaatggccaaattgatatttttctggctgtaagggcaagggataataataaagtaacgtttttctaagaataaatataaatatcttaaatataaagagcgtgagtaaagtttctttaaagtacattaaaaaaactgttatccaaaatgaaacatttgttaaaagaagtggattatgctattaaagatgtgccccccacccccatgtgtttgttcctatcgtagtaatgctgattgttaatggatggcatagtaactttaattgtgttcacaggcctttgttcttaaaattatgcactcttccctgttttttcttagcattttatcaatttgcatagaagagaaaatgatttgtaacaggtttctctggtcacatcactgaggagagtcaacaaaagaagtcattcaattgaggttaaatctttacacaaagaaggcattaatagcttaaaagaataaagaaatcctgatatggttattgtgacttttccatttatctggttatgaaataactaaaaaggttaattaaatgttggcttatttctaggtttagttatgcatcggtgtgtttattgctttctgtgccttattacactctgcttactaggtttgtgaccttgagccaaagttgttaattactctaagccttcttttctcatatgtgaaacaaggataataatggtcctctctctcagggctactgtgaggactaaatgaatgatgagtgcagttcagtgcttaacactgtgcttgccactgtagtagcttaatgaatgttagtgaagatgagtatttctgagagaaataagcaggacagttctatcttaaaatgcaggtttgaatggcttcacatacagggtccttgaaaattaaatctgatcttgttgctttctaaaagtatgcattattttagcttccatgttaatattcacatttgaatttgcaaaatgcttctgtgtatcatcagtactggcaaattgatataggaaattttgttgcttttcctgctttgtacatcaagaattggaggctaatgaaggttaattttcccaccaatgtcaaacaagttggtgtaaaagagtaaatagatctagagctgaactctgtagttctacctactagggaggctgaggtgagaggatcacttgaggccaggattttgcagctgtaatgcattatgagaataatgtgctatgtaaatagcaactgcgcttcagcgtggacaacatagcgagaccctgtctctaaaaagaaaaaagtaaatagaatcagacttttcctcattcactcagagtggatgattaggacctcaaagttacatataaagtaaagtcaaagactccacatgctaaagaaagccctaggcattagtggccagaatcctttccagggcttattaagatgtggcagaattaggtcacaagttggggggagaaggaattgtgccagaattgtcattgcagctattagtttgcctagcagggagcactgtagtttttcttcccttctccttcccttggagtgtccttcccttagaaacttagtgtggagaggtctaagagaaccattcctggaggttaagaatactagcagaagatggaatggagtatctgattacctaggcagtattaattacgcagcaggctggtttatctgtacctatttgagcaaaggataaggaaaattagaaatcccagtgtggatggaggggtggcagtgaccttcttttagttcaggtgggtaatgcagatgtaaccaggcaccagccttcttgccaggcaggctgtgctggacaggggagcaaaagtagttggaagagggtgagctgaggctgggcaaggtgatgcagacctataatcgcagtactttgggaggccgaggtgggaggatcattgagctcaggagttcgagatcagcctgggcaacatggcgaaaccccgtctctacaaaaagtataaaaattagctaggcgtggtggcgggcgcctgtggtcccagctgctcaggaggctgaggtggcagattggcttgagcccaggaggttgaggctacagtgagctgagatcgtgctactgcacatcagcctaagtgacagtgaggccctgtgtcatattcccagcttcttgggcaactgaggcaggaggactgcctgagcccagaaggttgaggctgcagtgagctatgatcttatcactgcacttcagtctgcgagagagagaccctgtctcaaaaccaaacaaaacaatacaacaaatggagggtgagctgaagcagatcttcaggtgggctgagagcctctagtctcctttgtcatgaaagaaccccacttgtccccagaagaaaagctatcatttgtctgcttgtgatacagacagtgtagtcagtattagccaggaaagtggcaactgagatagctactccagtctctctcctccctcccctattcatcagaccacaccccttcctccaggctagctctcttggactgggtgcacccaatctgaatttgaagagaaaggaggtgattgtaagactgaagattaacgttttaaactgtactttttaataaccaaaagctataggaacttttcaagatctccataagaagtggaaaagggagatttgaccaaccacaattagggatagggatagagaaacaattgtttcttgtgtttgtaccgatttcagaccctttgttaagagccttaagttcccattaccttaagttcccattaaggcctttggacacattaagttcccattaagttcccaccaaggcctttggacaccaaatcccattctctttttctccgtatgaggctgtcacagtactatagatgaccatttgatcttctcagtggcctgtttccaaatgcattctgattctcaatactattttagcattaagtgtatcatttaattttatctcagatttataagctgtatattatatgataacccttttaattggaatattaattcaaatatcttaattcctttttatggaattgttggagtttatcaaaccttggaaacgttaaataacataaaaagcactcaaaaagaaacactaattcaatattttatttttacttagtgtttgagattttgaattttagaaagttttaaattaatattcagctgttattcacatataaaaggtaagtaggttttagtttaaagaatgttgagcaataaaatataagattgagatggattaaatggtatctgacatatttccttactctgaatcgatttaacctttacaagtattctatgatatagttactattatcagttcccttttacatgaggaaactaaggctgcagaggttaagtagcttgtcaagggttgcatagttcctaagtggcagagctgggattcaaacccaggcagtctggattttagagtccatgctcttaaccacataattatattgtcaaatggaggaggagaattttaagatgaggatgtgtactaggcacagagttgacttttaacaattaacctctcttttaatatttaaaacgtggtagagattttccacatttaaattttccacagttaatctttgagattgattgattgattgattgaagcagggtctcacgcattccattccccaggcaggagtgcagtggtgtgaacatggctcactgtagcctcggctgcctgggctcaagcttagatcctcccgccttgacctcccaaagtgctgggattacagctgtgagccactgtgcctggctccaatttatacttttttactttactgattttgtttttcctttgcatcttaaacaatattaaaaggtcagtggcatatagttgtttaaaaaaatatttatccaaaattcttcccacataccttctttaaaaattagtgcttttttttttctcatctctgagatgtatacatgtttaattggcgatggtcagagataggttttttttttttttttttttttgagacagagtctttctctgtcgcccaggctggagtacagtggcacgatcttggctcagtgcaagctccacctcccgggttcacgccattctcctgcctcagcctcctgagtagctgggactacaggcgtcctccaccatgcccggctaatgttttgtatttttagtagagacggggtttcaccgtgttagccaggatggtctcgatctcctgacctcatgatctccccaccttggtctcccaaagtgctgggattacaggcgtgagccaccgcgcccggccagagatagatcttttttcacagctttaccatgagtattactcttaaaataaatgaccttgggtaggtgcttgcataacataattatgttatttgtatcgtttcatagaataaattaaaacctaccctgtgagagaacaagaagaaaaagagagtcagttgaaaatgaaagtgattaagtccatctgtggggcagtttttggagtcagattgagaaatgaaatctgatttttacctgttaatgctgctgaataataataatatggaatattattaaattgcttttgttctcttaacagtcatttaaatgtaattggttatggcatgtagacgtctaaaaatcatcccattcctttaaagtttcttttcaaaacaagtcttttttccctcctgattgcaaaaataatgcttacagaacaaattgaaacacatagaaaagccctgagaagaaagtaaaaatcccctgtatttatactactcaaaggtaacatctataaacattttggtatatatactgtaagtttaaaaaattctacaatgtttctactgtaatttaagaatttgtgcaaataagttgagtaaagctaagttcatcctgagcgtctgaacctggaatataaggaacttgaaatttgtaggggtgggggtatctgaatagaaatagaaagttctgaaaatttggctgtcttattctagttatcttttttttttttttttcctgaatgttcttcctttccttctcagcttttgccacttttaagtttttttttttaatcaagatgtttcacatttgatatgttcttcagtaataatagactaaaatataataagatgtagggaagcagaacctaaactgtaggaggttaaaaaccagatgaaggccaggtgtggtggctcacgcctgtgatcccagcactttgggaggctgaggcgggtggatcacctgaggtcaggagtttgagactagcctagctaacatatagtggaaccctgtctctactaaaaaagtacaaaaattagctgggcatggtggcgggcacctgtaatcccagctacttgggaagctgaggcaagagaatcacttgaacccgggaggtggaggttgcagtgagccgagatcacgccactgcattgcactccagcaacagagcaagactccgtctcagaaagaaaaaaaaaaaaaaaaaaaacacaacaccagatggaaatagaaaatctaaaacctctagcagaatgaagctagaaagaatggaatctaaacactgaaattatacatctgctaggcagctgtgcgttctttatttataggttctgttgtggaaatagcaaaagaaactttgaaagaaaaagatatcttaaatagactaagcatatattcttatcactgtgatatgcacatttttagctgtacagcatgtatttcattctttttttttttttttgagacagagtcttactctgtcgccaggctggagtgaagtggtgcgatctcggctcactgcaacctgtgcctcctgggttcaagcgattctcctgcctcagcctcctgagtagctagaattacaggcgtctgccactacacctggctaatttttgtatttttagtagagacagggtttcaccataatggccaggctggtctcaaactcctgacctcagatgatcgcccgcctcggcctccgaaagtgctgggattacaagcgtgagccaccgcgcccagcctttaattcatctttaaatgaattgtccccattttctaggagttattatcttttctaaaaataacataacttttttggattaaatttagatatcctatttatatcttcagcattgaatcaatattttattaaatatacattaagggagcttcagtgatactaaaagagtgtgatgctgttgtaaatttgccattgctttcctttttgtcaatattcaaggattgtcttggaccatgggccaagcctgaattgtaagaaggaatggtaaagcatggtaacccattaaagggtaaagaaattaaaaaaaaaaaattgtcagagatatactctttaaagggccagattttttttataagactttaaaaagaattgatgattcttattttacacaaagatttttagaggaaagaaaaagtatgcaaaagagaagatgctctttgaagctggccataaccctgctgcaagcaaaatcagacaaggatggaccagaaaaagagaacaatttctattctcacttatcgtgtatttgtaaaatcccaagtaaaacacgagcaaattgaatcaaacagtatattgatactatcggataaagctagcccaagattcaaggatgatttgaccttagggattatattagtgtcatttacactaaataaatctaaggaggaaaacaatacaaccatctcagttaatggtaaaaaatatattaaatgaaattaagtaactctttgtgatagactagttttaagaaaagaaagaaccttcctcaacctgataaagggtaattttctacctggggcgtgtagcaaacccaacgggtaaaatacttcccgtgaaaggaagaacaatactaagttcatttttagtgttctttttagtgctggagaccccagccaatggactaagagaagctgaagcgaaaaagttgtaaatatttgaagggaaggtcagaatgtgtactgtttgtttatgctctttgctaagcatgtaatctacctagaaaagccaagaaaatcgattgacaaactgagaaaactaataaatgagttcagtaagttggctctacacgtggtaaacgaggaaatccatacataggttcctgtacaccagcaatagccgtgtgagaagtactgtcactgtctgttacatctgataaaacctgcctattaatctttggcctgcttgtcagtttcttgtcccagacatgctttgagtcatgaggagagcactccaggagatgaggctttcagtttcctgcttatctcaacacgaaagtcaaatgttgtgaagggtggacacaaggctgatggtttcatgacagccccagagagcaaaattcattccccctgatgcccatctcaccctgctatagaaagtttcattttttggacagcatttcctgagagaatgtatcactgagttttctggagacctgaggtctaatccttagtaatctgcagaaataccaaaggatatactaaggaaaacagaaaaggcattcctctaaaaatagctagttttttttttaatgtaatagcttgcagtaaacaatggcaacaatacagaaaactgctttcctccctactctctttgctctcccctctgtgctgtttccttttccttggtaaccagtgttgttactgtatgtatcttcctaagattttctttccatttacaaaaatgcatatccattttttggtgctttgtacagatggcatcatgcattgtgcattgcagcttgcctttttcacctaacattttctctatctccctccttttcggctgctcaccctggggttcatttccccgcagctctgtctgttcccttggcagtcctctcccactgctctccaactcctgacaccttccattgtctctctttttctatttgccttcttgttcttaaggattcttaaatgttttaagcagcctctgttccccttcttagactaatgtttttaaatgggtaaaatacgtaagacttgtgaaggaaaacaattattttgaaatatagctattaacatttttagatatagtaatacgtttgttcttttattaacttattaaataatccaggggtgagtataacaactgccctaatttttagatgctgatgagcataaataatgctttgagttgcctgcagcaagtagtttgatgagaatatctgatttgtttttattacaaagtcacaggtgttgctaatactactgtgtatcctgcctactctcataagtaaagaaaaattcaaagttcggttagtgaaaataaaaatgtaatctttttcacatctaaggttatgaacctcttgaattttgtgaggccatgggcttctgaataagaacttctgcagttgaaacttggttcacactggaggacactgattgttttttgtagtccactcaagcagtggaattttctgttgcagaccccctttccttgggcctggaggggttatcctttaccccctttgctacttccagatcactctccctcccaccttccttaacatcaaatagaaaacatgatattcaatctcatgatacatcttgtagttttccatggaaccttgactgacttccttctcatttaatgaagattttgtcttatatggctcattttctctagtacttctttattctagttcttgatctcaacatccaggtgggagactcttccactaccttcctggcctcttaatatcttgacttcctgcaaagtttccaccctacctcagctatcatggtcataccccagttctgttatacaataataacaaaaaattataaccccttccataatttcagttctaccctgatcatcacttcccactttactggctcatgccttctagtgccaacaattcttttatctcactgagacttagaacccattgaccctattatctttgcactgttcctcaccatactctctccttatgtccttacccttctctttattcagtttaatttctgttgttggtcatgattgttcagttgcaaatattctcagtacacttgccctcacttgcttcattgcttaatagagaaaccccagtttctctattaagaaccgcagttggttaaatccaactgtgcctactctacacttgtactttttaaaaatgtggtttagaaaaatggatatcaactgggcacggtggctcatgcctgtaatcccagcactttgggaaggcccagacaggaggattacttgaacccaggagtttgagatcggagtggacaacatagtgaaacactgtgtctgcaaaaaaattaaaaagttatttgggcatggtggcatatgcccgtagttccagctacttgggaggctaaagtgggaggatcacttgagcctgatgaggtttaggttgcagtgagctgtcattgcaccactgtactccagtgggtgactgagcctgaccctgtctcaaaagaaaaaaaaaagaacatgtatttaccctcttaacaattattaagtatacatcacagtgttacaatattgttcattattttatacaacagatctctagaactttttttttgttctctgcagttacaagcttttaaaaattttatttttaggccaggcgcagtggctcatgcctgtaatcccagcactttggaaggctgaggcaggtggatcacctgaggttgggagtttgagaccaggctgaccaacatggagaaaccccgtctctactaaaaatacaaaattagccaggcatggtggtgcatgcatgtaatctcatctaccggggatgctgaggcaggagaattgcttgaacccaggaggcagaggttgcagtgagtcaagatggtgccattgcactccagcctgggtaacaagagcgaaactcaaaaaaaaaaaaaaaattaaattgacaaatgtacgtatttagggggtacataatgttgacataaatgtacatatttatggggtatgtagtgatgttttgatacatataatgcatgacaggcttgtccaactcatggctcatgggctacatgtggcccaggatagcttcgaatacagaccaacacaaattcctaaactttcttaaaacatgagattttttttgcaatttttttttttggtagctcatcagctatcattagtggattttcttgttgttgttttatttaatttttttatttaaaaaatacataatttttaatagaaatggggtctcaccatgttgtccaggccattcccaaactcctgagctcaagcagtctgcttgccttggcctcccaaagtgctggattacagatgtgagccaccgtgcctgccctgccgctagtgtattttatgtgtggtccaagacaatttttcttcttccatcgtggcccagggaagccaaaagattggatacccctactgtacagtgatcagatcaggataattagcatatccatcatcttaaacatttataatttctttttgttcggaacgtttgatattctccttctagctatttgaaactgtatattattgttcactatagccttcctaccgtaggataaaggataaagtactagaatttattcctcctgtcttgctgtaattttgtatcctttaacaaatttctccctgtccctccctttcctctacccttcctatcctctgttctgtgttttacttataagttttttagtttccacatgagtgagaacatgtggtgattaactttctgttcctggcttatttcatttaatataatgtcttccagttccatccatattgctgtgaatgagtggattttatttatgtattttctttttttttttttttttttaagtagagatggggtttcaccatgttggccagtctgatcttgaactcctgacttcaagtgatccattcctctcagcctgccaaagggctgggattacaggcatcagtcaccatactcagcccagattttattttttatgactgaggagtattccactgtgtatgtataccatattttctttatccattcctctgttattagatgtcccgtttgtctaacccatatctaggctgtttgaatagcagtaaacatggggatgcagatgtgccttcaacagaatgatttcctttcctctggataaattcctagtagtggaatgctggatcatatggtaattctgtttgtagttatttgaggaaactctgtactgttctgtcttgtggctgtactagtttgtattcccaccaataaagtgtaagtgttcccttttctcctgtccttgtcagcacttgttactttttaaattgaattgtttatctttttccccgtttgcccatttgcccatttttaattggattgtttatctttttcctgttgagatgtttgagttacttgtatattctggatattggccattctttttgataatagccgttttaactggggttagagttgtggttttgatttgcatttccctgatgattagtgctgttgagctttatttatttatttagacagaatcttgctctgttgcccaggctggaatgctgtggcctgatcactgtccactctaagctcaacctcctgggcttaggcaatcctcctacctcaacttcctgagtagctgggactacagatgtgtgccaatgggcccagctaatttttaagagttttttggagagattgggtctcgctatgttgcccaggcttgtctcaaattcctggccttcagcgatctttcagcatcagcctcccaaagtgctgggactacaggtgtgagccaccatgctctgcccttctttgtttttgttttgtgaaagagacaggatctccttgtcacccaggccagaatgcagtagtgcgatcctaactcattataaccttgaactcctggcctcaaggtatcctcccaccttggcctcccgaacgctgggattacaggcatgagcccctggtaatagcacctggcctatttcatttgttttttggccatttttcttcttttgagaaatgtgtctgttcagatcatttgcccattttttaattggatttgttttgctgttgagatgtttgagttacttgtatattctgtatattaatcccctgttggatgagtagtttgcaaatattttctcactttctgtagctcgtctcttcatgatgttaatgggttcttttgctgtgcagtagctttttagtttaatataatcccatttgtttatttttgcttttgatgcctgtgtttttgaggttttacccataaaatattttcccagaccagtgtcctaaaatgtttcccctatgttttcttacagtggtttttatcatttcaaatcttttttttttgagacggagtcttgctctgtcgctcaggctggagtgcagtggcacgatctcggctcactgcaacctccgcctcccaggttcaagcaattctcctgcctcagcctcccgagtagctgggattacaggcgtgcaccaccacgcccggctaatttttgtatttttagtggagacggggtttcaccatgttggtcaggctggtctcgagttcctgacctcatgatcctcctgcctccgcctcccaaagtgctgggattacaggcgtgagcgtgagccaccacgcctggctaaggatttataatagatttaaagcattctgatgggcaaagaaccagggaaaggaaagtcaaaggcagtactgtccaatatgacatgtaattttaaactttctagttgccacattaaaaaagtaaaaataatcgtgtgaaatcagttttgttttttcaattgagacaaggtctcaccacgttgcccaggctggtctcaagctacttgggctcaagcaatcctcccacagtgctgggattacaggtgtgagccaccgtgcctggccaaaatcagttttaatatatttctttaatctaatatatccctaacagtatcaccatgttggtcaagctggtctcgaactcttgacctggtgatccgcccgccttggcctcgcaaagtactgggattacaggcgtgagacaccatgcccggctctcatttcgaatcttacacttaggtctttgatttcttttgagttgatttttgtatagggtgagtgttgggcgtctgcttttattcttctgcatatggatatccatttttcccagcaccatttattgaagagactgtctttttcccaatgagtgtttttggcacttttgtgagaaatccgctggctgtagataggtagattaatttctgggttctctgttttgttccattagtgtatgtatctgtttttaatgctgcaccatgctgttttggttactacagccttgtagtatattttcaggtgttgtattgtgatacctccaactttttgctcagggttgctttggttattcgggggcttttgtggttctgtacaaattttaggatttgtttttccgtgaagaatgtcattggtattttgatagggattgcattggatctgtagattgctttgtgtagtatttctggcactttctcatcttgcctgactgaaactctgtactttagagcaactccctatttccctctcccttcagctcctggcaaccaccagtctaccattttactttctgtctctatgagtttgattatttaagatacctcatgtaagtggaattatgcagtacttgttgttttatgattggcgtatttcacttagcataaagtccccatggttcatccattttgtagcatatgacaggatttctttttttttttttttttttttttgagatggagtctcactctgtcacccaggcaggctggagtgcagtggcgcgatctgggctcactgcaacccccgcctcccaggttcaagtgattcttctgcctcagcctcctaagtagctgggattacaggcatgagccaccacgcctaatttttgtatttttggtagagacggggtttcactacgttggtcagcctggtcttgaactcctgacctcaggtgatcctcccgcctcggcctcccaaagtgctgggattacaggtgtgagccatcatgccaggtccaggatttctttagggctgaataatatccagttgtgtatatgtaccacatttgttgatccatttatctgttgagagacacaagttaattacacgttttggctattgtagtgaatagtgctgcagtggacaagagtatgtaaatatctcttcgagatcctgttttcaatttttttagatatatactgagaagtgggatttctggatcatctggtattccattttaaattttttgaggaacgtccatactgtttttcatagtgattgtactgttttatagtcccaccaacaatgcacaggagttctaattcctccacatccttgccaacacttggttttctgtttttttgttttttgtttttttttgatagaggtaattttaactggtgtgaggtgatacctcagtgtgatttgatgtgagttttgccgatgattagtgatgttgagtagcttttcatattttttttggccatttatgtatcttctttgtaaaaatgtctattcaagtccttagctcattttaaagttgtgttatttgtggtttttgttttgttactgagttgtaggagttttttttttattctggatattaaacccctatccaatacatgatttgcaaatattttctctcattctgtaggttgccttttcactcttccttggtttcattctggttttggttgattgcttgccttgctgcacagaagtttgtaagtttgatgtaattctgtgtctatttttgcctttgttgcctgtgctttttgttttgcagccaagaaatcattgccaaattcagtatcatgaagcttctctatgtttccttctagttttatggtttcaggtcttatgtttaggtctttaatcaatttttagttattttttatttatggtttaagataaggatccatcttcattctgttgcatgtggacatccagtttttccagcactatttgttgaagagattattctttccccattgcgtagtcttggctcatcatttgaccacatacacaggggtttatatctgggctgtctgttctgttccattggtttacatgtctgtatgctagtactattttgatcactgtagctttgtaacaagttttgaaatcagaaagtgtgaagcctacagttttgttcttaatcaaggttgttttggctatttggggtcctttgagattacttactgatttcaggatggctttttctcattttgcaaaaaatgacactgaaatttgatagagattgcattgaatcagtagattactttggatagtatgtacattttaacaatataaggtcttccagtccttgaacatgagatgtctttcccatttgtgtgtttaattttttcctcagttttttgtcatttttagtgtacaagtcttttgcctccttgacgtttatttttaagtattttattttagttttactttatttttttagaaacgggatctcgttctgtcacccaggttggagtgcagtggcgtgatcatggctcactgccacctcccactgctgggctcaagagatcctcctgcctcagccttccgcgtagctgggactacaggcctgcatcaccatgaccagctaacttttaaattttttgtacagatggggtcttgccatcttgcccaagctggtctcgaagtgctggaattacaggtgtgagccactgtgctggccttattcttaagtattattcattttgatgttattataaatggagttattttcttaatttcctttttgtgttgtttattgttaatgtatagaaatgcaacttatttttgtgtgttgactttgtatcctcctgctttgcttagtttattataatagttctaacagtttttttgtgaaacccttagggtttttcatgtataaaatcatgtcttctgtgaatggagataattttacttcttcctttccaatttggatgcctttttttcttgcctcctttttctgattgtactgtgttgagtagaagtggtgagagtggacttcctagtcttgttcctgatcttagagggaaagctttcagtttttcaccattgtaatgtttgctgtggactttttatgtatggtctttattatgttcaggtaatttccttctattccttcctagtttgttgagtgtttttatcatgaaaggtgttgaattttgtcagatgctttttctgcaccagttcagattgttacatgatttttgtccttcattcggttaatgtggtgtattacatttactgatttttgtgtgttgagccatccttgcatcctaggaataaggctccctcagtcatcgtgtatgattttaatatgcctttgaatttggtttggtaacattttttgagaatatgtgcatcaaagtttagaagtgtttcttcagtttttttggtgagactttgaggaggtttggtattaatttttctctaaacgtttggtagaattccccagtgaagctatctggtcctgggctttttttgttgttgggaagtttttaaaattactgagtcagtttccttactagttataggtttgttaagattttctgtttcttcgtgattcagtcctggcaggttgtgtgtttctaataattcatccatttcttctaggttgtctaaattgttggcatgtgatcgttcatagtagtctcttatccttttcatttctgtggcatttgttgtaatgtcccctctttcatttctgattttaattatttgagtcttgtttttttttcttaaatctggctaaggatttgtcaattttattgatcttatttaagatctttttaaatgtaggcatttactgctataaacttccctcttagcacggcttttctgtatcccttaagttttggaatgttctgttttcttcttcatttgtctcaagatgttttctaaactgccttgtgatttcttctttgagtcattagtttttcaaaagtgtgttaaatatttgtgaattttttagttttcctactgcttttgatttcccattgtggtcagaaaagatacttgctatgatttcagtcttcttaaatttgctaagacttgttctgtggcctaacatgtgatctgtcttggagaatgttgcatgtgtacttgagaaaatgtgtattcagctagtgttgggtgtagtgtttttttgtttgtttgtttttgagatggagtttccgctcttgttgcccaggctgcagtgcagtggtgggaactcagcccaccgcaatctgcgcctcctgggttcaagtgattctcctgcctcaccttcccgagtagctgggattataggcatgtgccaccacatctagctaattttgtatttttagtagagacagggtttctccaatttggtcaggctggtcccgaactcctgacctcaggtgatctgcccacttggcctcccaaagctgggattataggcgtgagccactgcgcccggccgggtatagtgttctttatgtgtccgttagttccagttactctccagtgttcaaattctgtgtctcctcattgatccgctctccggtggttctgtccattattgaaagtggggatactgaaatctcctgctgttactgggttactgtctgttttttctttcaattctgtcagtgtttgccttgttatatttgggtgctctggttctgcacttgcacctttacagctgcgcttggctggagaattaacttggctgattggccttaccactaattaccactaagttcaggagagtccttaaaactgcacagcagtagttcctagttcatttattctcccagtgtgacctaaatgatcatttagacctgctccttctcaatccttcaacgtcactttcaccgtctttagcacacaactttgcttttcattttgttgagaaaacagataccacaagaaaaatatctgcaaagctcctgccactactgcctgtgtctgtgcttcatgtattctcacatccctcaattattacggaatgaactgaccatgcttctagccagggccaaaacctgcactgtgctcactcagcccttgcctctacactctgcagggtcattctcctccacaacaacatactgttgtttctctcatcttaaaacacaacaaaacttctctgaactccatttttccttctaaccgttgttcatttcccaccccgaccccttttttccctaaaagaagtatctgcactttgtttccaatttttctcctcctgatatttcaggaggctttccctcccagcaccctgtttcttgcactgctcttgcgaggtcagctctgaccctacctttctcatccttgaattatttgacctagtaacagtatttgacactggtgattacttatttcctgctcgttgaaacactttgttcacttggcttccaggatagcatacaaagaaattccccatctcagtcttttgtcacagagtccctccagggctcagtccttagacctctgttttaactatgctcatttccttgttgatcttatttgacccactggctttgaaaccctctttgttttaaagtttgacggaagtccaaattttaaatctccagcctgagccgcttctttgaaatgcagacttatgttccacctggatgtctaataggcaaatgaaatgcagctttctctaaagggaacttattcttcctccagtaacttaatgggccatgcttagaatggctctttttgtccaagaaaattcaaaaccaaaaccaaatctattttcttctgctttaacatcagtctacagattatttttggtctaaagcatgagatagggctttttatttatttttaatcaggcggctagctagtttcttaacagtattgaataatatatttttaattgtttgaattgtcatctttattgttctgagaataatatcaaggatttaagtgaaattgccatctaatgtttgcattatagatttcatgcccctttaaaacatgtgttatatcaattgagagcacactcttataaagtacaatcaatgataatcaatggattttttaaaaaagaactaaataagttgcataagagcacagaaacaaactttaaatttagcatttaatagaccaggaacaacacaccagtaaagaaaggggtcactaattactgtttggatacttggattttagtttgaaaaataagtaaaatttacatagtaaaaagcaataaagtaaatttaacacggaaagtaacaatggagtatgaaatatatgaccaaactaatggaagtttctgtctaaaataaaagatctatttgtagggtaagtaattagattgggagtaaaaggcagaaatagtaaaatcatcacatgcacaaatgctgtctgtatttaatcccagttaaagacatgggaaataagataaccctaaggctataatgctcacctattaaactgacagaagtatgtaatatgaggaaatagcatgtcttgtttggtcagtgtattagtcgattctcacattgatacaaagaaataccaaagactgggtagtttataaagaaaagagaattaatggactcacagtaatgcaggctatacaggaggcatggctggagaggcctcaggaaacttacaatcatggcagaaggggaagaggaagcaggcctatcttcacatgacagcaggagagacagcaaagaggggaatgccacatgcttccagatctcttgagaactcactatcatgagtacagcaagggggaaatctgcccccccccataatccaatcatctcccagcaggccccacctctaacactcaggatcacagttcaacatgagatttgggtgggaacacagagccaagccatgtcagtcagtatcataaattggttcaaccatagaggaagagaatttgactaaatacatattttagggaaaagggaagtactgtgggctcagcggtttgatcttaaaatttctatgcagtgatggcatactatattcctaatctaactagggtttgtttcaagggaattagggataaggtgagtaagctagtaaacccaaggcaaaatttcttaatgctttttaaaatttaaaaaagaggcccattccgttagagcatacattgaatcaaatgtttcatgtaaaacaggatggaaatgaacttttctatttggctaagtggtgtaggcagaaaaacctataggctttctcttttcatcaacttcatgctgagtcctgtctcattttattatttacacaattgaaatataaaaaattgttcccaaatgatgccccccataccctaagtttagggggcagtagtgtaaagcagtgtccagacattggtcttagggctggagtggaaacagactcctagaggtgcacaagcacatggataattttacctgaatcaatttccaaatcctaaactttaaatgtctcttttttgaagcatttcttcctttgaaccagtgttcaagcggttcttccctttttattttttgatgtggagtttggctcttgtcacccaggttggagttgcaatagtgtgatctcggctcactgtaacctccgcctcctgggttcacgcgactctcctgcttcagcctcctgagtagctgggattacaggtgcctgcaccatgcccggcttatttttgtatttttagtagagatagggtttcatcatattggccaggctggtctcgaactcctgaccttaggcgattcacccacctcagtctcccaaagtgctgggattacagttgtgagccactgcgcccagttctgttttcaaattcctttccaccatggctttttccattattaaaaaaaatggcataactcttcctctgacccttctcttaccatgatgcacttgccttgtagtgggaaaacctcagggatgaaaagggtgtcaggacaattctaagacaccaatggaatagtgctggaagaattagatattcagttgcaaaagaatgcaattagacctttacctcataccataaacaaaaatcaactcaaaatgaatcaaaaacctaaatgtaagagctaaaaccataaaaatcttagaagaaaacataggtataaatcttggtgaccttggattaggcagtgatttcttcaatatgacaacaaagcacaagcaatcagaaaaaagtagataaattaaactttatcaaaattaaaaacctgtgtgcataaaaggacgctgtcgagtgagaaaacaagccatagaatgggagaaaatactgtaaaatatatttgataagcagcttgtgtctagaatacataaagaacacataactggctgggcgccgtggctcacacctgtaattccagcactttgggagactgaggtgggcggatcacttgaggtcaggagttcgagaccagcctggccaacatggtgaaacgccatctctgctagaaatacaaaaattagctgggtgtgatggtgggcacctataatcccagctgcttgggaggctgaggtaggagaattgcttgaacctggaaggcagaggttgcagtgagccaaaatcatgccactgcactccatcctgggtgacagagtgaaaactctgtcttagaaaaaaaaaacaaacaaacacgtaactaacttagaaaaccaaaaatctaatttaaaaacaggcaaaggattcagatagacattactccaaagaagatgtacaaatggctacataagctcatgaaaataatgtcgttagtcattagaaatataaatcaaaggctgggcacggtggctcacgcctgtaatcctagcactttgggaggccgaggagggcagatcatgaggtcaggagatcgagaccatcctggctaacacagcgaaaccccgtctccactaaaaatacaaaaaattagccgggcgtggtggcaggttcctgtagtcccagctactcaagaggctgaagcaggagaatggcgtgaacccaggaggcagagcttgcagtgagccgagatcttgccactgccactgcactccagcctggacgacagagcgagactctgtctccaaaaaaaaaaaaaaaaaaaaaaaaaaatatatatatatatatatatatatatatatatatatatatatatatatcaaaaccacaatgagattctgcttcttacccactaggatgtctataatcaaaaagatagataataacaaatgctggtaaggatatggagaaatgggaacctccagacactatttgtgggaatataaaatcgtgcagctggtctggaaacagattagcagttcctcaaaaagctaaatgttgagtttccatatgatccagcagttccactcctagatatatatccaaaagcattaaaaacatgttcacacaaaaatttgtgcatgaaagtttacagcagcattattcataataggaggaaacaacccaaatgtccaaccgataaatagataaacaaaatgtggtctgtctaggcaatggaatattactcacccatgaaaagaaatgaagtactcactcattttacaacatagatgaattttgaaaacattaatgcaggttgaaagaagtcagtcacaaaatatcgtatgttgtattattcttatttttatgaaaggtccggaaaaggtaagtccacagagaaagtagattagtgataaaaatgtactggaattagtgttgatggttgcacaactttgtgaatatgccgatagctactgaactgcacactttaaaagagtgaattttattatacgtcaattatatctccaaagaatggaataaagcctcaggggcccccaaagtggtgattccaaatattggttttagtgttaagaaaatgaatggccatagcctttggagaacaaatcctttcatggtttttcagttttccacttctaacaaaattgaaggatcaattccaatatttacaaataataaatgtgttagctactaaatcatttaaaatatttctggtggaaaacaactatgtaattttcaacagataactcagaagaaattttaaaagtcatgtgacccaactgacagaattccttttatttccatcacctgtttatatgagcaagccttctcagtgcttgctttttttttttttttgagacaaagtctcgctctgtttcccaggctggagtgcagtggtgcgatctcggctcactgcaagctccgcctcctgggttcaagcaattcttctgcctcagcctcttgagtagctgggactacaggcacgtgccaccatgcctggctaattttttgtatttttagtagagacggggtttcaccatgttggccaggctggtctcaatctcctcacctcgtgatgtccccgcctcggcctcccaaagtgctgggattacaggcgtgagccaccgcacccagccctcagtgctttcttgaaacacacgcacagaaaagtagaaattcactaagtgatgtctgattttagcaataattattcaaagagatacatgaactaatgaagaaaaaaaaaaagccctgtccatctcattaagagacgtacatttccagtaatttttctttccttctttacttccttcctccctccctccctccctccctcccttccttccttccttccttccctccctccctccctcttgctctgttgcccaggctggagtgcagtggtgcactattttggctcactgcaacctctgcccctgggttcaagcatttctcccatgtcagccttcccgagtagctgggactacagatgtgtgccaccatgcctggcttttttttttttgctagagatgggggtttcaccacgttggccaggctggtctcaaactcctgacctcaagtgatcgcctgctttggcctcccggaagtgctgggattataggcgtgagccactgttcccagcctccagtagaatttttacctttaatgttgttaattactgtcagatcttttttttttttttttttttttttagatggactcttactctgttgctaggctggagtgctgtggcatgatctctgctcactgcaacctccaactccctggttcaagcaattctcctacctcagcctcccgagtagctgggattacgggcacacgccaccatgcctagctaatttttgtatttttagtagagatgggtttcaccatgttagccaggatggtcttgatctcctgacattgtggtccgcttgcctcagcttcccagagtgctgggattacaggcatgagccagcatgcctggcctactgtcagatctttaatgtttgccatttaaatgaattgcatactgctaaaaattataatggtaattgaattcaaaataattttttaaacacttagaagcttctttatggtcaggaaatttaaaatgtttttcatttaaacatcagacaggctgggtgcagtggctcaaacctgtaatcccatcactttgggaggccaaggcaggaggattgcttgagtccaggagtttgaaaccaaccagggcaacatagggagaatctgtctctataaaacaaacaaacaaacagaacttcagacatgtatgactgagtgactaataagacttccaagcattagcaattactatatgcagggcaaatgtactggaaatatgaattcaaggaggaaaatatgctgtgaaaatttcactttaaaatggatcatgatgggtatcagatcacaattgtatttggattctgttgaagagatttaaggttgatattacagtgaccttgctaaattatattgctgttctgtgctctgtttccctatatataaatgggataataatagcacctatatcaaggagtaatttattattatgtctagtgcagcttcttggcaaatactctgttcagtgattcacattctgtttaatagcccactgctttgtttctttctggtaagtcttctgccttaatgcagtcttctctagctactatgtgtccttttttcatcctcctgatctatacccccccccaccccccgccaccccacacacacatggtggtgtggacaaggcaaaaaagaaagttagctggatttatgtttcggaatttcagggctttgtatttacagttgacttgttaggagaagaggaagaagaattaaaaagtatagcattgggccagaatatcattaagcagtaagatcacattgagttgtatagggaagggtacctgtatttttatttcatctgtactggagacaggatttctgatgacacgcttgctcactgacagtttttttttttttttgagatggagtttcgctgttgttgcccaggctggagtgcaatggcgtgatctcggctctctgcaacctctgcctcccggattcaagcgattctcctgtctcagcctcccgagtagctgggattacaggtgcatgccaccacgcctagctaatttttgtatttttagtagagacagggtttcatcatattgatcaggctggtctcaggtgatctgcctgcctcggcctcccaaagtgctgggattacaggtgagccactgcgccaggcctgacagatagtttttttagatggtgtaagacagtgtcaattatgtagtgtagttggtatattttctgttgttactgtaacaaattaccatacttttagtggtttatagagcacaaatttattatcttatggttctgcaggtcagaagtccaacacaggtctcactaggctaagatgcaggtgtctacagggccgtgttcctttcgggaagttctaaggaagtatggattctgtgcctcttacagcctctagaggctggctgcattcctggatcaggctccccttcctgttcaccttcacagtcagcaaggtgacatggctctgacctcctgtcatctctttcccaccgtacttgggagaagttctctgcttttaaggaccatgtgagtagattggtcccaacaagctcatccaggataatcgccccatctcaggttttggacccttagtcacacatctgcaaagtcccttttgccatttaaataacatattcataggttacagggattaggatgtgaatgtctgcaggggccattatcctgctaccacagttggtttttagtcagctacataattttgaactgttaattttatctattttttttttatgacagttgtggttagaggtgaggcttggattggtcctggcctgaatcttgttctgctgtgtagcagcactgtgacgttaggcaagtttcttctctgtacttgtttcttctttggtgaaatcaagatagtaatgcttgtctgtatgtactgaaataaagtaatagtttagggttctagatgggaggcaagagatttctaccaatctttttgtgtctgtctcaaataagcaaatatgtgatcacctaactcacaaggttgttgtgaagatcaaattaagtcatcaagttagagtgccttttgaaatgtataaaaagtatataacattttgttggtattaattttagaatggcttttaagatttttgtcaaaggtgagaacgttcagtacattctttgatacctgcctagcaactatttttaggtttctattcctttccagattttcagattcacatatttcctttattaaattatggtaaatgaaaagataatatgagaattaaaagtaatgacttctgtgattcgtatagtcactaggatttaaaattcaaatttatctatatctatatctatagatatagatatatagatatagatatagttttttttttttagatagagagtttcgctcttgtttcccaggatggagtgcaatggtgccatcttgactcaccgcacactccacctccttggttcaagcagttctcctgcctcagcctcccgagtagctgggattacaggcatgcaccaccacaactagctaattttgtatttttagtagagatggggtttctccatgttggtcaggctggtcttgaactcccgacctcaggtgatctgcctgcttctgcctcccaaagtgctgggattataggggtgagccaccactcctggcctatctagataatttttaatctttatttttttttttctgtagacttatttggagctatactatatgtgttgtagaagcaaaataaatactaagtctaccttgcattagtaagactgatttttcttaaatcctgagctacatttaaaatcttggttagtagacattttactcagatagtgattcatttataattggcttgtctaagtactcagtgtttgacaaaaatatcactatgttaagcaaaaaccatatttaaaaagtgatttgttttttttttttcctaacgctgtaacagtgaatagatctttttcccctaagcagcacaaagatgccattttgggaggttaaattactttctaaaagttgctgtgaaggagagaaggaaaagagatcaggttacacattctttgttcctgagcctaccactgcacacgttcagagaagcaatagtgaggctagagtatgcatttgccactatgtcttcaacccttccccatagtagggagggagggaattaggcagttttcctaacagggccccgaagagtaccattttaacttaaatactcttaaaagttgctacttattttttttaaggctttctttacttttttataatttagcatttcaagtaatccaaatagttatttctttgtatattcagaggtatttaaaaatattttctttgagagcttaaaggttatagtttaataatgcagttaaacatcaatttatctcaaattgatattgagttaaatttaaagagtattttaaattatattttgaggggaaaaaaataactttcttggcacaaaatggccatgaattagattgtgtgtttcagaaaggtagtggtaaaaagtccccaaagcagttacaatatttcttttgttctgtttccttgctactcttagataaatgaagagtttgaaaagaattttcacataaaaacgtcataaaatcccagtgccatattctgaatattaatttgactgttttatgtcgtatttttttcccagttggttttagttagaatatatgcttttttttaagcctttaaggaattaaacaattttggttattaaagtttaaatgtatttcataaatatgtatttataaatatgtgactggtcccttttctgaggggttaggaagtttaagcattatttgtaagctatttgtaaatccctgtcaaacattatttgtccattaagaaatactatttttttcttcacttttaggtcattttaagtattaataatgttcatcaatttacttactacccttctgaagaaagtcactataattagtaatcagaattatatcacataaatttaggcacatttatttatttatttatttatttatttatttatttatttttagtattttgagagtaggtgctgtattttcttttctttccttgtttcttcttttttgttttttgagacagaatctctctctgttgcccaggctggagtacagtggcatgatctcagttcactgcaacttccccctcctaggctctagcagtgcttccacctcagcctcccaagtagctgggaccagctcacgctaccactccagctaatttttgtattttttgtagagacagggttttgccatgtcaccgagactgagttactgtattttcttagcagaatattgtcccagtgagctttttccaaaagagaaaaggtacagccaataaaagtttgtggttgggtattgggagttggtgttgttctgttttgtcctgttcataaaagttttattctctttagctctcatgctttagttctaatttattcacagatttttgcccagtaacttgattttatacttggctttctatattgtggctccaatttttcttcccagtttatactcttatttttcctttctttttcttttcttttcttttttttttttttttgagacagtcttgctctgtcgcccaggctggagtgcagtggcgcgatctctgctcactgcagcctccgcctcccaagttcaagcaattctcctgcctcagcctccagagcagctgggattacaggcgcctgccaccaagcccggctaatttttttttttttttttgagacggagtcttgctctgttgtctgggctggagtgtagtggcccaatctcggttcactgcaacctccacctcctgggttcaagtgattctcctgcctcagcctcctgagtagctgggattacaggcgcccaccactatgtccagctaattttttgtatttttagtagagatggggtttcgcagtgttggttgggctggtcttggaactcctggcctcgtgattcgcccacttcggcctccctgagtgttgggattacaggcatgaactactgcgcccagccaatttttgtatttttagtagagacgaggtttcaccacgttggccagcctggtcttgaactcctgacctcaagtgatccgcccacctcagcctcccaaagtgctggggattacaggcgtgagccaccgtgcccggccagaatttgaactttaattcttcaaattgtatagcattttcaggtaccatcgagggcttttcttctgtacttctgtgtgttcaaatatggaccttgttccaaaaaggtccaaaaaggttgagttgtggttccctgtaatgtcaagaaatctgttaatgcatgagacccggaagatgtttgaaagtgactagtgagaattgggttggttgctgtaggatattgtcatttaaattattaagtgaatatatttatatatttaaaaattagatgtaggtaagcctcagaaatgggaaaatggagataaatcttaggagagatttttgaatcttttacttaagactgtgttcaaaactttgtctatttgctatttattattttgatatattaattgctagtgagattaagacatttttgacacatcctcttcatttaaggtcatggatgttttgtatcattcttatataagcatatttgtaagacttttagaggtattccttttttagtcctatttttttttactagggaattatgactcattttggcacttagcttttgtagcttactaccgtatgacattttatatctttgcaaaaaccaagtaattagaccattcatcacaatttccatacttaaaaaactaatactaagtttttacatgttatcaataaaagtagcattttaacaattatcctttccacattatttgataaatgctattggttttgtctgttatttttataaatatataatttgctttaattacttaaatgttccttgagccttagaacttaaatcctgatgagggttttactttttaaaatactgaagtttattatttatgcatgttttacagaaaaatgagtggcttttaaaagatcaaaattaaaggcttaaacatggaatctctaggacatataaaatatgagtagaactgtgtatttataagatgttaatgtaagacttcaggccttgtaatatcttaaaggaaccacttcactgtaagggagcagtttgtctttctacctttccaattgtattgagattttgcccagtatgtctttttacttaaacaccttggtgaaagctatccagcatcctgttttaaatctcctttgttgcacttaccataattactttcagatctgtttccattctcagaaactgaaactgtaagctcatgtgagtggggaatccgacttgttttattgcatgtgagctgagcactgtgccttgtgtcagtagtcagtggtgttcctttagtccttgttatgttaataaaaaagctttggtttttgcaagactttgtttttagagattctggaaaggaacatattaaccaaaaagaagagctgacttcaattttacttgtcttgaaaataactgactactaaagggatgtcagggaacattagtgaaaatggagaacttaaggagttaaagttttagctgtttttttcaaaggatattgtccttcaaaatctttaccttgcatttttgttactgtgatttaagatggttgtaattatcattgattgatgatacctatcaaaaggcaaccctaaccaaccatttctgctggattctgaatgccgagaaagaaaaactgagaaatttgtgaactattacaagtcgtctgtaaaatgagataataatatcaacttcacaaggtaatttaggctttcgtgaaaactagagtgtgaaaatgcttagtaatgtgctgggcacactgcaggtgctctacaaataactactgataactactttttttcatgagtaattgtacattttctttcttccttcctttcttccttccttccttccttccttccttccttccttcctttcttttcttttcttttcttttctttcttttctttctttctttttttgttttcttttgttttgagacaagatcttgctctgttgcccaagctggagtgaagtggtgtgatcttggatcactgcaacctctgcctcttgggctcaagtgatcctccctccttatcctcctgagtagctgggacaacaggcgcacatcgtcacacccagctaatttttgtatttttgtagagatggggcttcacttggtgttgaattcctgggctcaagcgatccacccacttcgacctcccagcgtgctgtgattacaagagtaattgtaaatttaaaatgaatttctttcccatcccaaaccagtatcaaaatgcaaatatagtaaattactttttaaaagagagatgtttaatggcagttgttggtagtcttttgagtctttaagtgggtatattatagaaaaacaacatatctctgcttggagggaagatttaactaaaaacaagaaaaagaatagtagatgaaccatgattctttaacatacaggttgcaaactagtgacctgtcagttggatttggcctgtaggcatgtttttggcttataatgtaattttttaaaaattagtggccaacaattaaaaattgggagagttttcaaaagaaaatgcagatttctgactcatcttgaaaaatggtaagatgggcagcacagggcctgtattcccaattgcagccctcagtggagctaagtaggctgttctccctgccatctgcccggctctcagttgccatcactcactgcatttggactctttcttcatatagtgagccgaggggggagtgatagtctcatgttcctatcaaaagagggaaacctaaaataaggccatttttgtttttgtttttgttttgtgagacggagtttcgctcttgttgcccaggctggagtgcaatgtgaaatcggctcaccgcaacctccgcctcccaggttcaagcgattcttctgcctcagtctcccaagtagctgggattacaggcttccgccaccatgcccagctaatttttgtattttttagtagagacgggatttcaccatgttggccaggttggtcttgaactcctgagctcaagtgatccacccgcctcggcctcccaaagtgctgggattacaggcatgagccaccacacctggccaggcgatttgtgttttaagaaaaacaagaaagcatgtaattctttgcgaaaataatgaacatttctatttatatctgtcaaaagtcctgtttcttaggagttaagacataattcatagcaattaatatatgtggagaagatacgtaatgaaaaactaactagaagaggaattcagacattgaaagggattattttaaagtgagaataaaattagtagtgccgctgtgaggaaaataatcttcacgtacttacgtatgatgagaaacttcctaagtgtctagagatggcaagaaactttgtatgttttgcatgacagtaattgtaaatatgagcttatctggaaatattgtttgcatagatgttaaaaatatgggcaggacaatgtgtactaaaatgctgaattctagtgaggctgacataagcttattttttaaattctttaatttttgtttttatatattttttgagacagggtctcattctgtcacccaggctggagtgcagtggtgctatcacgggctcactggagccttgacctccccacgctcaggtgatcctcccacctcagcctcctgagtagttggtggcgtgcgccaccatgcccaactgatagtttgtattttttgtaaagatgaggtttcactgtgttgctcaggctggtcttgaactcctgggcccactcaagccatccacccaccttggtctctgaaagttctgggattacgggtgtgagccactgtgcccagcctgatagaagcttagagattaatatcacctagttagctctgtttgtgtatggtatctgtgtgaattttgactgtttctcccctctcttctttagtcattacccctgtttttggttcattcctatcagtaaacaatctctggtagagacttggtaagaaaactcaaccattcccttaaaaaaagtcagcctctaccccttccttagccagatgcttcagggatggtctgcttgcaacacttcctgtccttcaccttctttcaactgtttaacctgccttattcttttttttgtgagacggagtcttgctctgtctcccaggctggagtgcagtggcgcatgttggctcactgcaagctctgcctcccgggttcacgccattctcctgcctcagactcccgagtagcttggactacaggcacccgccaccatgcccggctaattttttgtacttttttagtagagacggagtttcatcatgttagccaggatggtctcgatctcctgaccttgtgatctgcccccctccgccttccaaagtgctgggattacaggtgtgagccaccgccccccacccttgcctgattcttattctcttgtccaccacagtttgcattcctcaggccatttttgtctgcgtcgttgagggcctccattgtccagccccatctcctttactctctcagtagcatttggcacagctggctctcctgtgccaaactcttagccgctgtgacacaactctgcatatagccttccacctctttcagcacagtccagatggtggtgagggacgctccagatcagggctgaggatggtgtcttgttggcttctgcccttaccctgaatcccttaagccctgtgtacagtgagtatcataattctggccttatatactgtaccctacattttgggctaatttatgaaaggataaaaaataggacttggaaagtaaaaataacccatgttaaagaatctgaactacattagtactttttgcctctatactgcacatacaaatgcttgaatgactatgatgtaaaggaaagggagaagaaactaaaaatttgacgtgggatgtcacattcaaataagcagttttttcccctttagaacatttgcttataacctaggtcatttaaccagttgaggttcaagtagctctcagatcagctggtgcaagcttgagggagaaaaaaaaaaaaccatccttacagatacttctcattcattaacctcgaatgttagctttaatcagtttaggaatttgtatgcattttagtaactcaacaccaacttgtcagaagttagctgaattttagataatttctttcattccagccaaaaataataatcacagacatgtttaaaaaaaaaaaaggagttaattgggaggctgaggcaggaggattgcttgagcccaggagttggagacctgcgtggacaacgtagtgagactccatgtctccaaaaaagacaaagattagccaggcattgtgatacatggctgtggccctatctagggatctgcactctagcctgggcgacagagcaagacccggtctcaaaaaaaaaaaaaaaaaaaagaccctaagcctttttttactgcatatattcctatccattctaggaaaagtcagttgtcaaatcaaagtgaaaaattgttttctttaaagtgaagtcagatgggtagaataaaatatactgatgttactgccatagtcacaattctaaagcacaacataattgtaataatgtcacaagcttaccaaggttgctacatgaaacagaagaaaattaaatttggtgttatttatttttataaagagacagcatctcactttgttgcccaggctgatctcaaactcctggcttcaagcagtccttggcttccacagtgttggaattccaggcatgagccaccctgcctggccattattatctttaataacaatttacatcagccacatttttctttatggtttttacttttgatgtcaaacttagacatttttttccccattacagtagtgttttccagttcttttatagttttacattttatatttgaacgttttatttatctggaattagttttgttgcataacgtaaggatccgacttaattttttcccaaatcgttggcaaattctttcaccactctttattgatttgagatgttacttttattatattctcatatatatttggatctacttttggtcttttgtgacctatctcttgacagtggaatcacactgtttatatcagtatagctttgggtacattttaatacttggtaaagcaaatttttctgactttttcaaaagtcgaggatatttgtttatttttccaactgtctttagaaatgttttatctgattctactgaaaagtctgctaatattcattgactgattgatttgatttggagaggactaccatctttacagtatatagtttactaattaataaattcgcgtttcatctttcacaagtcttcttttttgactttcagtaaagttttgtagtttttctcatgtgttatatttttgggtgctattgtgaatgatactatttttccactatattttctaaccagttttgttaatacatacacagcttactaatttttattaaatcattcaacatatttaacttctttttctaataattttcagtttattctcataggggatttaaaatatatcatctttaaataataataactttgctaaatcagttttaatatattcacaattgggacttagtaatatatgggtttggttagtagttttgtatcacatagttttcttttattttgagacagagtcttgttctgtcgcccaggctgaagtgcagtggcgcgatcctggctcactgcaactccacctcgtgggttcaagtgattctcctgcctcagtctccctggtagctgggactacaggcacccaccaccacacccggctaatttttatatttttagcagagatggggtttcgccatctcctgatctcaaactcatgatctcaagtgatccacccacctaggcctcccaaagtgctgggattacaggcatgagccactgagcccagccacacatgattttctttatagaccctatttacaaatttatggtctgaggtactggggattaggactttaatatatgaatttaattcatttattaagtgcaagattggtgcaaggttggtgtttgatgatttcctcagtctttattttgtgaccaccagtgaataacccaagtatttgtgtttttaaacacctttatttggtcaagtatgtctcatgtctataaaaagttttgaatttattttagcttaatgtttgtaggtgttttttttttttttttttttttgctattctaattattttatttgtttgtgtgggtttagaatagcagaaatttattgtctcccaattctagaggctgtacttccaaaatcaagggatccaaaataggagtgtccgcagagccatgctccctttaaaggtaccagggaaggatctgcttctggcctccttcctaactcccggtagcctcaggcgttccttgggtttcagatggcagttttatccctgtctctccccacatgtctgtggtttcatatctagatgtctccctttttataaggatggtatagtcatataggattaggccctaccctgataatctcattttaacttgattacctctgtaaagaccctatttacaaatttatggtctgaggtactggtggttagaacttgaatatatgaatttaattcatttttattattttgaaatcatttcatacttagaaaagatgtaggaataccattgtgaatgcccataatcttcatacccacattcaccagtttttaacattttcccatatttgcattataattctctgtttctgtctcttcactcctacctgtacacacacacacacacacacacacacacttttaagagtgaggttgtatatattatgcccctttacccttactatttcagtttccttttttttttttttttttgagacggagtctcgctctgtcgcccagcctggagtgcagtggcaggatcttggctcactgcaacctccacctccccagttcaagcaattctcctgcctcagcctcccgagtagctaggactacaggcgcgtgccaccacgctgggctaattttttgtatttttagtagagacggggttttgccatgttagccaggatggtctcgatcttctgacctcatgatccacctgcctcggcctcccaaaatgctgggattacaggtatgagctactgtgcccagccttcagctttcattttctaaggacatggatattctgtgtaatcattcttcagttatcaaattcagggagtttaacattgaggcggcactttgatctgcagtctgtattccagttttgtcagttggcccaactgaggtgttttttttttttttttaaagcatttttcccttccagtggaggattcaatctggagtcacatattgcatttggttgtcctgcctctttaatctccttctctctgaagcagttccttagccacctgttgtgtttcatgacatcaacatttttgaagaacaccaggccagttattttctagaatattcctcactttgggcttggcattttctcattattagattcaggtgatgcatctctggccagaagtctacataaatgacgacgtgtccttctagggtatcagaagcatactatgtctgtcctacctgtcattggtcatgttaattttgattacctggtcaaggtgttttccagtttctcttctctataattactgttttccctcttgtaactagtaagcagtctgtggggagaaacttcaagaccacacaaatttcttattcctcataaaattcactgctcccctgcagatttaattggtcttgactatttatagttgtagaatggtgatttttccactttcatcactagttctacatttatcattctgaattctgtaagaacccttcttactcccttatgtatgtatttgatttatctatttagttgtcatcactatggagtgatagactccatttcgttcaatgagttatagtccttatggatttttttcatcagggtctcactcctgttgcccagactacagtgtggtggtgcgatcacagctctctacagccttcacctcccagactcagttgatcctcccatctcagcctcccaagtagctggaactacaggtgcacaccaccaaacctgacgaaatttttttttttaaagtataaatgggggtttcaccatgttggccaggcttgatactcctgggctcaagggatctgcctgtgtcggcctcccaaagtcctgggattacaggcatgagccactgtacctgaccagcccttatgttttctgaggttcatgttgtcccagattttgatagcgggagtctcttcattccggctctcgtgtcctttggatatggccttgtcattttttcttccctttaaaaaaaaataaagagcacttctttatgccatagtgatgttccaggcttctataggaccttctttgccccatccccagaatcagtcatgtctctaaggagccctggtttctgttagtgggattcaatatatagaaaccaagatctgggtcttaggtgttctcattgatactggggtgtcattggttctagccactttcaacaaatgtatctaggaaatagactattattttttaacatactatctttaaaatcatttttagtttatactaatacttctaattctaaaccaacccctcaggatttttttggcctttccccagtccatttcattctaatttcatttccagtttatttttaatttaaaaaaattgaagtataatttatggatttgtgtatttagtgaaatgcatagttcttttttgacttacttgtttatctgacacagaatctctctctctcatccaggctggagtgcagtgacatgatcatagctcattgtagccttgaacttctaggctcaagcggtcctcctgcctcagcctcctgagtagctggggttacagatgtatgccaccatgcctggcagatttttaaattttttgtgtagagacagagtcttgctatgttggctagtctggtcttgaattcctggcctcaagcaattctcctacctcagtctcccaaagagctgggattacaggcatatgccaccatgcccagtccccatctttcttatgtattccgtttaatctgttttgacagtgcatacgcttctgtaatctctatcaagatactgttctatagttgtggttttttttccttttgagacggagttgcactctgttgcccaggctggagtgcagtggcactgtcttggctcactgcaacctctgcctcctgaattcaagcagttttcctgctttagcctccctacaagctgggattacaggcgcacacctccatgcccggctaatttttgtatttttagtagagacggggtttcaccatgttggtcaggctggtcttgaattcttgacctcaggcaatccacccacctcagcagaactcatttgggcctgttgttttctgttttggaaggttactgcttactgatgcaatatctttaatagatataggcctatttggattatctatatcttcttgtgtgagttttggcatattgtgtcttttaaggaattgatccatgtcatctaaattatcaaatttttaatcatgtttgttcataatattcctttataatccttttaatgtacatttagaagggatctgtagtgatcttttttttcatttctgatactagctatttgtgtcatctttttaattaattggcttagctaaaggcttatcaattttatgatcttttcaaagaaccagcttttagtttttcttactgatttcctattttcagtatcattgatactattatatttttatttcttttattccacttactttggatttaatttgctctttgttttctattttccaaaggtggaactgtgagctttggtccattcaacttatttcatgtaacgtcaattcaccgaaagagttaagagatttgaagcaatggcctgagtttgaatcctagttctccactcattgacaaaccacttgtcctgtctgaaccctatctcccataaaatggaagaaggatattacttaagttatgagattgcttgaaattcagttacaatgtgggtgaaaactgattttaaactgtgaagtgctacagttttgatattatcacttccttaaatgtacaaagattatttctttacaatcaccattggaattttgcctcaatttatggtcaaactttgtctggttttcagtttccagaatttccatctctcacctgctacccaaatcaggatggctaccaaacctgcccatcttcagtaatctttcgtttctctgattcatcacaggttacttatagggatccagttatcttccctgaatgtttctcagtatttgaattgtaaattataatcctgtcttggaacaaaagaacttgaactcatattgagtcctgtgctcacctatctgttttgatcttcttttattatgagtcgttcattcattgtgaaaaatctcatttcagtgatagggaaggcaaaaaaaatcagtctcctgacttttttcctctcctgttttattaaaattataaaatatgcataacataaaatttaccatcttaaccattttaaagtatacaattccagttgcattaagtatatttacagtgtcatggaattatcactactatgtattttcagaactttttcatcatcccaaacaggcccccctcccttttttttttgagacagggtctcactctgtcacccaggctggagtgcagtggcacaatcatagctcactgcaacctccacttcccatgctcaagcgattctcccacctcagcttctcaagtagccgggactacaggtgcgtgccatcacacctagctaatttttgtatttttattttgccgagatgcggttttgccatgttgcccagtctggtcttgaattcctgggctcaagtgatcctcctgcctcagtcttccaaagtccggggattacaggagtaaggcaccacacccgacctctttttttttttttttttctcttttttctttttttaagagacagggtcttattctgtcgtctaggcctcagctcctggcctcaagcgatcctctcccctcagcctccccaagtattgggattgcaggtgtgagccaggacgcctacccgcaaacagaaactctttacccattaaacaataactctgtagtattccttccttcctgcccctggtaaccactatagtactttctgtctaatatgaatttgcctgttcgaggtgcctcatataggtggaattgcatatttgtgcctggcatatttcatttagcacattttttcaaggctcatccatatagcacgtatcagtacttcatttcttttagttgctgaatattattattattattatttttgagacagagtctcactctgtctcttaggctagagtgcagtagcatgatctcggctcactgcaacctccgcctcccgggttcaagcgattcttgtgtctcagcttcccgagtagctgagattacaggcgcccaccaccacgcccgactaatttttgtattattattattttttagtagagacagggtttcaccatgttggccaggctggtcttgaactactgacctcaggtgatccacccgcctcagtctcccaaagtgctgggattacaggcgtgagccaacacgcctggctgctgaatattattttattgtgtagagtaatgtattcattcgttggttgataaggcatttgggttattttcaccttttggctgttgttccagataatgctgctatgagcatatttgtacaggtttttgtgtggaaatatgtttttgtttctcttcggtatataggaaaagaattacagaatcaactctgtgcttaaccatttgaagaactggttttcttttccaaaatggctgcaccatttacagccctgccagcaggttataaaagttccagcttctctgcatccttggcaacatttgttattatttttttattatagccactcaggtgggtctgaagtattttgtcgtgttttttatttgtgtttccttgttactgatatcgttcagcatatttccatgtgcttattgctcatatgcatatgttctttggagaactgtctgagattctttgctcatttttaactgggttatttctctttttattgttgaatttcaatggttctttatatattccagatacaagtccttatcagttacatgatttacaaaaattttctaccattcccattccttgagttgtcttttcactttcttgatggtgccctttgaagcacaacatttgtgtgtgtgtgtgtgtgtatttttagtagagatggggttttgccatgttggtcgggcgggtcttaaactcctgatctcaggtgatccacccaccttgccggtgaaccaccacagcacccggcccgtttttggtttttttgtttgtttgttttttgagccagagtattgctctgttgccctggctggagtgccgtagtgccatcttggttcacggcaacatctggctcccgggttcaagtgattcttctgcctcagcctcccgagtagctgggattacaggtacacaccaccacaccctgctaatttttatatttttggtagagacagagttttgccatgttcctcaggctggtctcaaactcctgaattcaagtgatccacccgcctcagcctcccaaagtgctgggattacaggcgtgagccaccactcccggccagaagcacaatttttaatttttatgatgttcagtttatatttgtttttccctttgttgcttgtatttttgtgtgtcttaatatgtcttctaagtctgttttaatggatggattctccccttcctgcctctcatttatctgttgaagaattttgcctatttgacctgtagagtttcctatggtctggatttttctaattatgttcccatggtacagttcagcttctctctgtctctgtatttcctgcaaattggcagctacaccaagaggtgtgatcagattctgatgttcaagggcttttgtctatcttacaggcagtcagtatgctattatattaggagacacacaatgtgtggttgtgtctctgtgatattattttagtagctttgatgctgaatgctgattaggtcttcattggggtttgcaaatgtatgatagtctaattctgttatcatttgttagctgacaaacttttgtttaaattttattttaaaaattaataaaagcagggacaggaggatcgcttgagcccaggaattgaagaccaccctggtcaacatagtgagacatcatttgtacaaaaaattagaaaaattagccaggcgtggtggtgtcaacctgtagtcctggctgttcgggaggctgagatgagaggattgtttgagcccaggaatttgagggttgtggtaagctctgagcatgccactgctctccagggcaaaaaagaaaaaaaaaaaccctaaaaatagagcttttggggatatacagttctatgaattttaacacatctatagatataacaaactacaagtcattatacagagcagttcagtcaccggaaaacctcctgctatccctttgcagtcacacccctacttcaccccaactctggaaaccagcaacctgtttcctgtcactctagttttgtctttttgaagtaccctcttgagactgtgttatttagcattatgccttttgagggtcatccaggttgttgcatgtgtgaagagtgttgtccctttctgtggttgattatcattccattggatggatgtgccagttttttattcgttcacttttagaaggacttacgtgttgtgtccagtttttggcgatgatgaatagagctgctctatacattcatgtatacatttcttgcttgcacataggttacatttcaccagctaagtacctaggaatgggattaccagcatattcctacagtgctgtatgccttttagttctccagggaataggaaagacaagatacatgcttgttctctccttttactggcagtttttaaaaacagactgtttcttagagcattttcaggttcacagcaaaattgaagaagtacgaagagttcccatatccccccaatccacatgtacatagcctgccccactctcaacatcccccactagagtggcacattgtttccaattgatgaacctatgttgacatgtccttattacgcaaagtctttaggcttcattagggttcactcttggtgttgtacattatatgggttatattatatattaaatgcagagtgatgtctattcaccattatggtatcatagagaatagtttcactgccctataaatcctctgtgctttctgcctatttatcgctccctcctctcaacccctggcactgatctttttactgtcttcatagttttgctgtttccagaaatgtcatatagttggaattgtaacaattttaaaaataatgaatttggttccctatcttctctgaaggtgattttctttcctttttgttttttgaattgttatgaactcatttgttggggttcagtccattgtaattcttacacctgttaaagctcaaattgttcgtttttggccaagggcagcctcttctggtaggcttctgagtccttctaaagtgactcatagtctgtgatttgtcccctcactaccttataaaatgagactttccgggaacatcttttacaatttctgcctcacacctggaatatctccaagaagccttgggtttttttcagtgggaaatggtatttcaaaaccactgccaggactgttggggtgttctaatgcttattgctactgagttagtcttcgtttctaattctaagtggatagtgctgggaggtactaccctcggaatcctggttttcaaggacataggtgtggtagaatatttgataattactcgtttattttgtcacatattatgtctctgacagttacaaaacaacaatactaatatatccaccatgggttgaaaccagttaaaaccattctttgcatgcgctctccatttccccccattccctgtgcagttgtcttccatatatcaccagggcatgttgccattagaacgcacacccattatgcgcccttgtattctgttcctcttcgtccctgtgtagtcgacaggtaactatttagcgctcacctctattcctatgtcagtatccctctatctacatgggttctctcaaactcattttctagtagatatctctagaagggcttatgggaacaatattccctgagtttttgtatgttgataatatgtataatgtttatactcgaaagttctactggccataaaattcttggctttcattttccttccttgagtattttattttctggtataatatgttgctttggaaagtttgttgttaatgtagtttttttcccttataaattacttgatgtttttgcctagatgctcaagtttattttttccttaaaaatcctgcaattttactatatcttggtattgattattttggcccagtattttccagtatgcaatgtgtgccttaaatatgtagtttctaatttttttctggtgtcctggcatgtcatccaggctggcctctaattcctgggctcaagtgatcctctcgcctcagcttccccaatgctgagagtatgggctgcattagctcttttttcttaattttggcaaaaatttcttggattacagtttttagtgttgcttgttctcctgcttttgctttctccagggattcctgttatataagaaataggaacaatttttgttgctttctttagaatcctattatttcatcatttcgtttttggtttttagaattatcttccttcttactttcaatttctcgaaggcattatctgtaatattcattcttgtgttccttgggttttattcttcatttctcaaataaatttttaaatttctaattacttactgagtcatgttctcacatttctgagtttcttctgttctgatgttgtttttcatgctttatataattttcttaatgtttttagctcattttgaaatactaatagtaggttctaattttaatctcctttgtgtttctggccttctagcatgatgtatttgtctgtaaggaggatgttgttttgttgttttgttcccgattccttcactgtttttttttgtttgtttgtttttttgagacggagtcttactctgtcgcctgggctggagcgcagtggtgctatctcggctctctacaacctctgcctcctgagttcaggcaattcttctgcctcagcctcccgagtagctgggactataggtgcgcgccaccatgctcggctaatttttgtatttttagtagagacagggtttcaccatattggccaggcttgtcttgaactcctgacctcgtggtctgccgcctcggcctcccaaagtactgggattacaggcgtgagctaccatgcctagccccttccccattttcttataataacttctatgagatttggatctgaaaactttgccatgggtcagttttattggaagttcattttcctgaatgtttggaagaaagcctagtgactcaggatagcatttctaatttcacagagttatttttccgttatgaaacacagattgcctttgaggtctcctgtttctactactgcccctcacttttatgtgggcctcctctttcctttgtttctggagaaccttttcctgttcaattctgttttaattttcagcagttttttttctgtgtgagtgaggctgtttcctagcagggaggtctggttggtcattttcaagttcatcagggcttcatcagggcttgtccacttcaacccttacgctataggccctttgcaccatctgcatcttcaaatgtgcccactgttcgttccaatgaagacttgtttgttatttggcttgtagagggacatggaagaagcaaatcagtctttacctctctcaaggctggagatttgcaggcactggttttatctgtaactggagatgagagttcaggccaaacactggtttaaaaatctgtatatgaaatagcgataccctggaatctaggactgagatcctgtgcctcacacccacccacgcggccaagtgcctacctgtggcagtgacttcttagtgctcgtccacatctaggtcttctttagtcccaggctgatgggaacatttaattcctttgctccttgatgttagatgggatcaggtgactgatgctggccagtggactttgagggaggttgtgttacttctgagttggcatagtgaaaagcccatgaagatgctctgctctctttcttgcctaggatatccctggtcataggattcatttgatgcaggaacaaggtggtcagcctggctctttgaataactggaaatggcccctgcatacccgtgttggacatattacatgaggcagaaataaatttctgttgtgctaagccattgaaatgttggggttgttaccacagcatcacttagacctgtgctgtctaacatggcagccactaggctacatgtggccatgagcacttgaaatgtggctagtcctaattaagatgtgctgtaactttaaaataatactatatttggaaaaaaaggtgtaaaatatcttaataatttttatattacatattaacatcttgtattcattgggttaaataagatgtattgaaattattttcagctttctctttagtttttttcatgaagctgcttagaaaatttaaaattatacacgtggtcacatttgtggcattatccgcagcactgacccctaccttagtaattcagtacccctccctcattttgacaaaagctggtcagttgattgtcagagaaactgaatcagtgaaactccagatttgaagagagtacagaagaggagtacactacagatggggattaagcgaaagtcgacctactggatcaggagatacacttccttgtctttaatttctgtccatgtcctttttccacttgtttgcagagcactgacaattggagttatacacttcacctaggagactgaaggactcttttctaagaaatcgaatggcttcaggaaagagatcaacagagcccgatatttaaggctctccgtatctgcacaagcaggagttaccctgcagtaaagcctgctagttcacaagcctcacctacatgcagagagggtccagttggggttgacgaaccactctttatgggaacagcacccaagatacaccagacactggtggaaaattctaacaggaattaacttgttaagggaaagataataataatatgagtctatgtgcatattatcagtgatctgtttgcatattaaataattcagataatgaaagtacaagtgaaaaaatgagtctttgcgataaagctcttctccagccatccccatttctacaatatttttttccaatttttaaaatcaaggtaaaatatacataccccaaatttatcattttaaccatttttaagtatatagttcagtggtattaaatacattcataatgttgtgcaaccatcaccaccatccatctcccatactcttttcatctggtgaagctgaaaatatactcatcttgtaaagctgaaataacaactctcccttcttccctttccccatccttggcaaccatgattctactgatgtctctatgatcttgactactaagtacgtcatataagtggcatcatttagtatttttctttttggtggctggcttatttcacttagcataatgtcttcaaggtttatgttgtggcatgtctcagaatttccctcctccttaaggctgaacaatactccattgtatgcatataccacattttgcttatccattcattcatccatggatacttgggttactttcacattttagctgttgtgaataatgctgccattaacgtggatatgcaactaaaagagtactgtaaacaaatgccaacaaattggataacctggatgaaatggacagattcctagaaacacaaaacctactaagactaaataatgaagaaacagaatatcagaatagacctgtaactagtgaggagattgaatgagtaatcaaaaatctcctgacagaaaagaaaaaccctggacctgatggcttcactggtgaattctaccaaacatttaaggaaaaactaataccattcttcaagttttcaaaaacaaaaaaaactggagaaagagaaccctttccaactcattctatgaggccaacatcacactgacaccaaagttagacaaagatactacaaggaaactacagataatacttcttaggaacgttgatgccaaaatcttcaataaagtactagcagagtttcctctaatattttaagaagtttgctgaagtgtgaatagttctttgattaatattttttcgagacggagtctcaccgtgttgcccaggctggagtgtaatggcatgatctcagctcactgcaacctctgcttcccgggttcaaacgattctcctgcctcagcctcctaagtagctaggattacaggcacctgccaccatgcctggctaatttttgtacttttagtagagacagggtttccccatgttggccaagctggtctcgaactcctgacctcgtgatctgccctcctcggcctccaaaagtgctgggattacaggtgtgagccaccgtgtcccgccagctaataattttagggagcagatgaagaggtcttcagactgcttttagctcaggtttttttgttttaaaatttattaagtggaaagaaacatgttaactgaagattgaagtttgctgaagtatgaatagttcttcggttaataattttagggcgcagatgaagaggctttcagattgcttttgtctcaggattttttgctttaaaatttataaagtgaatggaaagaaacgttaactgaggattagtgctagtttttcttgacaggtcatttcctatagggagggcagtagtataagcaaaacaacaaaatattcaaaattctcaaataagtactatttattattgaaaaactcagataaatgtagaagttattttttctctctattgagcagcagttacatatgctagaatcatagtttgaatgattcagactgtgtacctgtgatctgacatacctggattggagttccatctctgccacccactttatttgactccatagagaaattactcaagccccttaagacagacactgaaataggatacagtttccaagaaggcaagattttttggatttttttgttgttgttcattgctgtatgctgaggtttagattagttcctgggacacagaactagcagtcagtaaatacgttgaatgaacccgaagaattcctgcctccgaattgttttggggatgaaatgcggtaatgcatgtaaagcattgggcatgcaagtgaagccagccacgtattaaacagtactcagctcttacctctgtatcttatattcttatttccgtgactgtatcctcacacatgaagaaatggctacttatttattattattattactattattattgctacttattttttaaagccacttacatctctggagatctctgtatgtgtgttaaaaataccatgttttgtaacaattggcttgtcttagaaaacttttcaattatacagaatttgagatctttacaacttgaattttcttttttttctttttgagtctcgctctgtctcccaggctggagtgcagtggtgcgatctcaggtcactgcagtctctgcctcctgggctcaagcgattctcctgcctcagcctcctgagtacaggcacgcgccaccatgcccaactaatttttgtatttttagtagagatggggtttcatcattttggccaggatggtctcgatctcctgacctcgtgatccgcccacttcggcctccccaagtgctaggattacaggcgtgagccaccgtgcccggccacaacttgaattttcatagcaaactagtttttattgtcaaattagaaatttatgcttgaagcctagtgcttcttttgcctatgcatctcatctaaaagtaatggcacttatcacgtcagcctcatggattgtggtagtggttgttatccttggaattaccggtagggtaacagtctccaggcataccatgggttcttcagttatgagtggcatagcttatgtacatgttaactgtgaataataaacgatttttccaacttactgcaatactcttatttatgtctgtaatgtgaattgtccagaggagaagttgtggtcaattgatgattaggctgatggtttctgctagctctggcaaaaggtgaatccagttgctttctagcacttttcctactaaccctgcttctcaccctgtacctaataccacatttttagtttagtttttgttttgttttgtttgagacagggtctaactttctgacacccagactggagtgcagtggtgtgatcatagctcgtctgcagcctccacctcccaggctcaagtggttctctcacctcagcctcctgaatagctgggactacaggattatgcccccatgcctggctgtttaaaaatttttgggtagagatggggttttgccacgttgccatggctggtctcaaactactgggtttaagcaatcctcttgccttggcctcccaaagtgttgggattacaggcatgagccactgcacccagaatcacctttttttagtttggaagatgacatctttttttttttttttcttagagaagctagagggtaccaaattaaagtctgtcagttttttctgtctccacctcaaagatcactgtatgacttcttttcttccttctcggctgtttcacacgaagttttccctttttctaaggctcagtccttatcgtctgagacctccctctcattatccatctctccatccttgactgtttctagttcgattgtaacactgatcaaatctccttcaagttcaaaacaaaccagcaaaaccttcccttgatactgccattacctcagagctatgtaccgtgctccttgccctccccccggacttctccggatgctagttgatgcctgtttagcacctgtcactgtttcatatacttcttactggccactgcctggttggcatctaccacttctctggaatcagcaaccccaatagcagatttaactgctggttccatggtttttgttacttgtccttttttgcagtgttttaaataataatcatcttttcacttatttttttaaagaaggtcatttaaaaaaatcatcctgcagtggaaaatttggaaaatatggaaaagtataaagaagacaattatcaactgtaataccagcagtacctattgttaagctctagggcatgtcatttccatcgctctctttttaaatgcattaaacagaaaaggatcacatggttattttgtgatctgattttttctatcttaatatattgtgagtatatttccaagtacttattctcgtgtggcataacatttgtagttacacgaagtggcggtgttgagactgccttggttcaaatcctggcttcagttactgctgcagtgtgacctgaaggaagttactcctctgggttttagtttcctcatcttgaaaatagttataacattcttactaacttctagggttgctgtaagtattaagtgagctaacacatagaaataattcttggcacttaataaacatcagctgttattaacaatattgtctgactgtactataatttacattatttttgtttttgcttgttctgccgtcattaagcgtgttgtaagaccatacgtgtcactaaatctgggtgcacaacatgattttttttaaatgtggatttttattagtaggattgctcagctagtgggtacatcatgctcattgctaagttgctctctagagaggctgcatttatacctcccaaggctgtacaggagaccattaacttcattacatttttccaaaaaactttatgctattgcccacattttgtgctgctcccttgctaaaagtgaataacaatatgatcatgttgttacctctctcttgccaaaacgttgacttgatgataaggggatcactgtgacatcatcattacccacagatgtttcttttttctcccccctccccctctcttctccttcctccctccttttgtttcttgagacgggttcttggctctgtgcaggctggagtgcagtgacacaatcatggctcactgcagtctggacctcccaggctcaagtggtcctctcacttcagcctcctgagtagctgggacagcaggcacgcaccaccacacccagctaatttttgtattttttgtagagaggggttttaccacgttcctaggctggtctcgaactgcatgttcccaggctggtctcgaactcgtgggctcaagcgatccacccacctcggcctcccaaattgctgggattacagacccgagccagcatgcctggcctcacagatatttcttgatctacattttattcattatttaggtccaactttagcatgtgtcatgtatttatatacaggttctaaatctttccatttgaaaaatactcatttttctatccaaaatgaattcaattttcctttttattctagtcccagtctgtgtatgagtaaaaccccaaggaccctgtatcctgattttactattttttgttaatggtttgaaacagctttattaagatataattcacataccatacaattatttaaagggcacacacttcaatggtttttagtatactcacggatctgtacaaccattatcacagtcatgggcaattggttcaggatttgggaagaaaacgtatggcattaggattaaaagtacaatgtttagagtctggctgatctgggtttaaatcccaaatctaccatgtattaactgtgtgactttgagaaggttacttaatcactatgagcttcagttttctttttttttcccgtttttatttttatttttatttttattttgaggcagagtcttactctgtcacccaggctggagtgcagtggcgcgatctcggctcactgcaacctctgcctcctgggttcaagtgattctttgcctcagcctcccaagtagctgggattacaggccaccatgcttggctaatttttgtatttttagtagagatggagtttcaccatgttggccaggctggtctcgaactcctgacctcaggtgatatgcccgcctcagcctcccagagtgctgggattatagatgcaagccactgtgccggcctgagcttcagttttcttatctgtaatatgggattactagtggtatctggctcataggcttattttaaggattaagcaagataataaatgtatagaatttagcacagtaaccggcacatagtaaatgtttgataaatggaactcggtaaatattattgccataattttgttcttaaatcaaccagcaagtgtttgatgctattattaggcaatgttattaaataatggaaggtgtttctaccagtgattcacagtgttttctgtatccagcaagcttttaatacagctgcttgtattattctcccgtataaacttctaattactctctgaaaatacagttggtttcctgttgatagagaacaataacagtagcttacacttagtgcttactgtctgcctggcactgttctaagtgccatacctatattaactcctttgatcctcattttacagattgggtacggaggaggttaaacaacttggtcaaaggattacaacagttaagtggtggagccaggattctaaccttggtattcagtctggctacagagcccatgctctttcttatctttatgttcttctctttacttcctaaagaatggtagatgcatttcaaacatcctgacatcttggctgctgaggattctgtatggaaaagcactatgaggtctttaatgcttggttggaaggagaactaaaatgagcagttgtgtgtgctgtgggcatgggccttagggcagctgtatatttgtcatctggatcagaccatacattggtgatcctgcttcacaaccatagaatccagaccctccatggggccatgaccagccacaaagtatcctccctgaccctccctgtggaatgctcgtgtgaacttgcactactccctccttgcatagtatcaaatcctgcggatccttggaaggccaccttaaattacttcccacctgtgaagcagtaaacgttagtgctcttcggttaatcatcatgtgtggtggtatgacatttgcagtatcatctgttaccattatttaaatttgaatatctttatgtcttggctcctcatgttgattacatgtttcttgcaggcagggaactatgtcttaaatgttttaaaatttgctttaatggcccctggaaatattaccaagggttgtgtgtgtgtgtgtgtgtgtgtgtgtgtgtttctttcagtctcacttgtctgtcgataatagaatatctctgaaattcaaacatacctagcctcacaaacttagtcccaaaggtacatgctgtgtttttgcaagaaggtgggcagtccctagttggctgttggattatgtgcattgtgttggggtagtagttgctgctaattgcctgtctgcagctcctcagaacctgttgttgcttccttttgaaaccttccttgattgccctagttgctgctcatcctgcatccaggcccctcccttaggcatgtgactcacggatttaaaagacagtgctgtacggtaattaactacctgcctctcatcacacagagatgagaacttaaatgtaggcttcccatctaaaactttcttccctgtgtgtttatccacccacggacatggagcagcgctgtcccacacctggccttttggaggaaatattgctagacttatttctcctgtttgaaatcactagttggcatattcgtgtacaagggatggattttacatgggtgctcttaattgaaaataattttattttctgtaacttctagaattttgttagtttattgatgcacacatattgggtgggtgacagttgggttttttatgaagataattttaagtttttagtaaataattaagtcaagtattacatgacagtttaattggactaaattctgacataacctatacatccttaaggtgaccggtggttatcattttctatgaaatgtaattagtttttcaggaaactttgtccacataaaggaattgattccacccttactacctgcttagcaatcctgaaaaatattgtaaatataatcttagagtatgcatcattaggaaataaatctattttgagaaataaattttaacgtacactattaataggacatttagaaatgtaattttctaaatatattagaaataataggacatttagaaatgacattctttttttttttttccttgctttttgtttgtttgtttgttttaagacagggactcactctgtttcctaggctggagtgcaatggcgtgatcattgctcactgcagcctcaacctcctgggctcaagcgatcctcccacctcagcctctgaaagtgctaggattacagggttagccaccagcacccagccaagaaatcccattctaatgtattagtatggttttatctattttagcagtgtaaaataaagtctttgtgaattatatatagtataattgaattgccaaaataaacatccttgccctcaaattgcttatgatattgtttctgaagcacagacataatcttttgaccttttaagcaaaaaattaatttttcatttaactttttttgtttgtgtgtgtgtgtgtgtgtgtgtgacagggtcttgccctgttgcccaggctagagtatagtgatgcaatgatggtttactgcagcctcaacttcccaggctcaagtgatcctcccacctcagcctcctgagtaattgggactgcaggcacgtgccaccatacttggctaaattaacatttttttgtggaaatatggtcttgctatgttgcccacactggtcttgaactcacgggctgaagtgatcctcctgcttcagtcacccaaagtactgggattacaggtgtgagccatcgtgcctggcctttcattcaacttgtaattcacaatttccagaaaaaaagttttaaaattactgatggaggaaagatctttgggacttgcttgtaaatatgttaatatttgatcttaataagctctgtcatactaacactgtttattaaactttgtggtagaattactacccataactaaagaatgaaatgcatatatttgcaaattgttaaaaatttataaatcgatagaaaagttgaatgaatagtgaacacccttgtgtctttcactaactcagtggctcacttgctaacgtttgcctcatttgctttctctgtttataaagacatatatactttttttattcccctgagccatttgaaagtaagctgcaaacatcttgacatttaacttctaaacattttagcacgtgtatcctaagagcaaggttgtcttcctgaagagttacattatcatacttaagagatatagtattaatacaatattatctaacatgtgatccctatttaaatttcatttattttcttccccagaacagttctttatagatgttttaatttttgatccagaaaccaagggaaaaaatatatctatatctatagagagctaaatagatctatatttgatccagaaaccaatcaaggaaacacacacacacacacacacacacacacacccgcttttggctgtcatatttctttagtttcctttactttaggataagccactaccccacctccatctaccacccggcagtggtcttttatgaaatctcatcatatttttccttttcttatataagcagtcccacaatttgctggttatatttcatgcctagattaaaataagaatattttggaatgaatatactatatagatggcattaattttccattatattacattaggagaagtaattttttttacatgttttttttccgctgtataatagtttagtatttgttttaatatacttctgttaaagatttgtgatactgtgtctttaaatttcaaaatagaattttgtaatttactcttaattttcttagtatgttgtattccaaaattatagaaagtgctataatagacatttatgtacattacataaagtaatagacatttatgtaatgtgggcatagatttaaattttttttaaattgttaaaatattaacatttaaccatgtctgctttagataggtttaatcttacaaggatctatctacttatctttctatctatttataatgtatatatccattttaaataataataacaatacatgaataaatctggtccaaacttctatcttgagaaatgtaacagcaattttgaactccttcatccctcaagacaattattcctcccttcccagaggtaaccatcctcctaaatttgatgtcattcccttagttttttcttaagttttaccacatttgtgttgtccctttaacatacttttttttttaagcttttcctgtttttgagctttatacatatggaattattctgtatatattcttcttgggcttgatttttttatttatattacaattttgagatgtcatttatgttgacattgttagccgaagttcattaatttttcactatttgatataatattccaaattactggaatatggaatattctatgaatataccacagtccattttactgctgcttgacacctcggtttcacctagtttttggtatggaaaaaatactgctttaaatattcttttgcgtggctcatggtagctaagtacaaaaggttctctaggttatatgcatagacctggattgttgagtcttgggtgtatacaccatcagctttactaggtatggcagaatgtcttcttttacacagttgtggaataagccagatgagttcaagaggagcaagtttgtgagaggatggacaagtgagttagtgagttacatttcatttgttttgagttttagcctatttagttagaaatgttaagtaggcatttgagatgtgtttacttttttagctccacccatctttgttttttcctaggttgactcattcaggtatgtcatctctcccttctccttaaagtggcctttaaagaaaaaagttgcaggccgggcacggtggtttacacctataatcccagcactttgggaggccaaagagggcggatcacaagatcaggagttcaagaccagcttggccaatatggtgaaaccgcatttctactaaaaataaaaaaattagccgagcgtggtgacacgtgcctgtaatcccagccacttgggaggctgaggcaggagaatcactggacctagggaggtggaggttgcagtgagccgaaatcgtgccactgcactctaccctgggtgacagagtgagactctgtctcaaggaaaaaattgcagtatcatggtacaacaattacttgatcgtaatagaagatgtgttcagtttttatatcttcagtctcaggccatccgtcatatgcagcctttttgtttttatagaccttgaaccacagaactacattaagctagtttgctgttttccagggatgacataaaggagaagtgggtagagggtgatgctgttattagcaagtgtgcattccaggtagcggttcacaaaggggaaaaaacgtaaaggaaagacgggtgcaagctaaaacaaataagccagtaagtaaaaaaccacaacactcttttgtgattatttagatctgaaacaaatagcagcatgtattaatagtccctgatgatttcactgtattgtagcataactctggtattcataatgtcaattctgaatttctttatgtgttgagagagtgtaatcatgctgattttagcagatctggtgaacccttagcaatctagaatcactctctgataattcctgaattaacagtagaaatttaactgttttatgtggtgaaattattctaggaagcttgttccatgggacatttacctattagctaataaaacaaatggtctattgataatttctcaaaagctctgtataaaaaaaaaatatatatacaataatttctctactggccgaattggatttacttggaaaaagaaagagggtgttatcaaaaaatttaaatgtcttgttaggttcgtaagttgtagaacaagaatgagaatgtgcaagtgtttttatgcttcattgttgggaaggataaattgcaaaagaacatagagctgggtgattttctggggttcagtctgttgcgggtgccacagattggcactcccctcggaattgccacaccttcacggagccagaacaggagggatacggagggaaagggccctttcccaacttcagactgagcacccagaagttgacctgggactgctgttttgtttctaggaaactagaaaccttggcagaattgaaatttcgtagtgattttttcttctttgctctccaaaaaataaacttgtatgtacacacatatgtatatacactcacacctacataaaagaaagataatttcaaagaaataatatatctcgtatagtccttgaacagttattttactattcaaagtaggttcttcaaaatttttaatttgaaataactaggtttacaggaaattgcaaaaaatagtaaggagaggtcccttgtgcctttcacctttcccttaatggtaacttcttactacccacagcacagcattaaactagaaattgacattggtacattttatgtgtttagtgctgtgctgtttaaacatatatgtagttgatttgtgaaccactgtggcatcaagacacaaatgctgccaccaccaagctctcccttgtgctgcacacacctgccccatggcagccagtaatctgcttttcatctctatgatgttgacatttcgaggatattaataaatggaatcacatagtatgtgaccttttaaaattagcttattttcacttggcgcaattccttgagatctatccaagttgtgtgaatcaacagttctttcctttttattgctgaataggattccatggtttgtttaaccattcaccttttgaaagataatctctttccctagtttttggcttttaacagtaaagcagctgtgaacattcatgttcagttttttgtgtggacataaatttttatttctttgggagaggtgctgttaaagaaaaaaaaattattcagtgacacttgttaaagcatgggaaggaagacattattcaggatcatccctgtaagtgtagggaccactacaatagtgtcttacagtgggtggggagagagcgtggcctcagtgctggatgtagcatggggaagtgggaatttgtagccaaggagctggttgagggccagtggatggaaaattctcaagaggaaatgtcaggtgtaaggggtttctgcctaaactgaccgtaacaggattctttcttgctgaagacaggccaaggtgatcagacatcagctggagggtggcagaagaagaagagggtaatcagacaccttgacgggaggtttgctaatctggcttagcagggttctttgctaaaacaggaatttacaaggaagtacacagataggcctgggagaaaagttcaggagcctggctcatttggtcaagcaaagaatctttgccagagcccaggggtgtgcagttggtggcttacctgtaagtagctgtgccattttacatgctcactggcagtgtatgagagatccagtttcttcacattcgtgtccacatttggtgttgtcactatttttttattttagctgtgccagtaggtgtgcagcatagtttggtttgcgtttccctgatgtctagtaatgttgaccatatcttttcatgcgcgtatttgccgtctatatatcctcttcaataaaatgtctttatatttcttgcccattttctagttgaaatttttttcaattgttgagctttgagatttctttatatatcctagatgaggcttttatcacatatattgttagcaaatatattttcctagcctgtacctcatttttttgccttcttaaacaggtcttttgtagagcaaacatttttaattttgttgaagttcagtttatcgtgtttttttttctttcatggattgtatttttggtgtcattccccattccccattccccactctccagccccagacggccacgaatctactctcggtctctgtgaaattgcctattctgaatatttcctataagtggaatcatatgtctggcttctttcacttagcatatattcaggcctcatccctgttgtatcatgaaccagttctttttatggcttcgtttatttttaaggttgaataatgttccactgcatggataagaccacattttgtttagccatttgtcagctgatcggcaattaaggttgttttcacttcttcgtctgcatcagtacagctgcatgtgtacccttcagccctgcaccttccttatacacgatgcacagatgtacgcatgcgagtacttgtgtgtacggttttgttttcttttttaaataatggaggattaacttattttatagtttttttcttcgatatttgggatgtctttttatgtctatataaaaagatatatctcattattttaaatgactatgtagtgtttaatgtgactgcttaattgatcctattctaataaacatttagatgacattgggtaacttcttgtttttcttttttatataacagtggcaccaggcacagtggtttatgcctataatcccagcactctgggaagccaaggcagaaggatcacttgagcccaggaatttgagacctgcctgggcaacatagagagaccttatttctacaaacgaacaaacaaacaaaaaattatccaggcttgttggcacttgcctgtagtcccagctactttggaggctgaggtgggaggatcacttgagcccagtaggtggaggctacagggaattaggattacaccactgcactccagcttgggtgacagagcaagaccctgtctcaaataaaaaaatagtgacactaatcatccttgtacaagtgtcttttttggtgcatagctcattttacctacttttggatttttctcttcaatgccatttgtcattaacttatttagaagtgtattgattacctcctataggccaggcactgtactgtgtatcagacactagggacacaagcactagtaaaatgctatggctatactcaagttttttgtaaagatgatatacctataagtaggtaatcatggttcactgtgataagtgcacaatgtgttattactagaatcctgtggaacgaactgtagcagaaggtaaggcaggttacgttaaatagattgaaaacagattatagcagtctgtgaatgcccttctaatgaatttggacttcattttgtacataattagaaatcattgaaaaaggccgggcgcggtggctcatacctgtaatcccagcactctgggaggcctaggcggttggatcacgaggtcaggaattcgagatgagcctggccaagatggtgaaaccctgtctctactaaaaatacaaaagttagctgagtgtgatggcacatgcctgtagtcccagctacttgggaggctgaggcaggagaattgcttgaacccgggaggcagaggttgtggtgagctgagttcgtgccattgcactccagcctgggcgacaagagcgaaactccgtctaaaaaaaaaaaaaaaaagaaatcattgaaaaaatgtaggcacacttaaattttttaactttagtaaatttttgtgctgtgactgttttagaacactttatcacctcccacaatcactgccttctacctcctcatctaggcaaccactgcttattttctgtctctaaatttgcttttcctaaacatttatgcgttggaaacatacagtatgcagtatttttacattggcttctttcatctagcgtgtctttgaggctcatgtatgctgtaatgtgtatcagtattttgtgcctttttactgcctaatgatattccattctgtggtgatgacaatttatgtgctcagcaattgatggatgtttggattgtttccagtttttggttattatgaacaaagctgctatgaacatctgtagataaatctttgtgtgggcacatatttctcttgggaaaaggaaattttggatcctgtgataagtttatatataactttaagaaattagggcatggtggctcacgcttataatcccagtgactcgggagactgaggcgggaggattgcttgagctcaagaggtcaaggctgaagtgagccatgattgggctactgcactctagcctggacaacagagtgagacctcacctctaaaagaacaaagaaaaaaaatttacagactattcctcaaagtgactgcatcattttacagtcctgtcagcaatgtatgcgggttccagcttctccagatgctcgacacttggtattgtcttttgattatggccattttaatggctgtatagtgtatctcattgtagttttaacttgcatcttcctaatgacagggtgtttataatcttttcatgaagcatagttatattttagagacatgagtccaatgaatagaggtaagaatggaggtgagctacatgaaagatgagagcctacgtcagacaatatgtgtagagatggggagacattttaaagatacgtgtatcagagctagaatgagcagcatttagtaactcctgagtataatagatgaagcagagggaggtggggcttgtgatcccaagattttaaacttcggcaattgggcactttttggctaacggtgctgccattagccaaaaagtgactgccggtacataaacagattttgtgctggtggttgatggcttttatattgatcttattctcttgatgtgccactggaataaacatttaatagagtgtttggaaacatgtatctagttcaaaagaaggatctgggctgaggtataaatttagggcagtttacattgtgtagggaacaactaaattcatggaagtaaatgatgtatctgttcctaagtcaccctatctgctgagttacttgtgacaaattgtttaaacagtaaaagaatttaatatgaaaagatacacgttaagatgattctaggattaattcattcaggcatgacagcatcaccaaggacccaggttctttctatcttttaatgctgctgctgttcttgatctgttgggttgtcctcatggtccagttcttgtttacacattcaaacccagaattgcatgcaaaaaggctgggagcatgtgtttttacctgggtcttttttcatcagccaagaaaacttttcctaaaagctccctagcaaacttactttcttgtcttcttggccagaattgcattaggaatgtgttaccagactacccactggcaaggggaatggaaattgtcacagttggttcagaccagagctttctagcccaagtatttttttctgttatctcttctggaagaagccttttccccttgccttttgagtctcttctgtagttcaggtaagttagattttctatgcaacccagttttgtatcattgagttgttactattcaatacttcacaacagcaaatacttgccaaaatcctacactgtgtcatgctggattctaggatacagaaatgaataagaaacttgtagtttgacatagatacaagcttaaacagaagagtgctatgatagatttgtacactaaagttcttttggactatggatttagtacaactgtttatatgtttggttttatgagtaaaggcatcttgagtttcaaaatcaaccttatattcaatttataaatgaagttttggaaatttagaacgcaacccattcatgagttgaccctccctttctagttaggtggttacatgtttattataggggtgcatggtatactatcctaaagtaactgttcatttgagttatttacagctaaaaccacattatgtttttctggagcataatgtttgtgttttctagttatcgtaccaaagtaaacagtaatatctttagcttaagaacccaactgaaatgtttgtaaaatatagattgttttgtaatttggctctttttttttaatggtcctatgaatgcaactatagtgtttgcagtatttgtacagtgcatggggtgctttttctgggtgctgagaagggaggagaaatgatagggaagaggggatttggagtagccgaaggaaaaaatgtgcaatcagtgttgttgattccaccgaattctaagaattccattacatcttgatatctggtacaagctcaaagttaatcttaaattttggcttagggcatggccgtacttgctggctacttgggaggctaaagcaggaggatccttagagcctggaaggtcaaggctgctgtgagccatgaccgtgccactgcactccagcctgagtgacagagtgagaccctgtctttaaaaagaaaaaaagaaaaaaaaaaaaaacagaaaaaaaacaaacaagtgtccaggagtggtggctcacgcctgtaatcctagcactttgggaggctgaggcgggcggatcatgaggtcaggagttcaagaccagcctggccaacatggtgaaaccgcatctctactaaaatacaaaaattagctgggcatggttaatcccagctactggggaggctgaggcaggagaatggcttgaacccaggaggcagaggttgcagtgagctgagatcgtgccactgtactccagcctgggtgacaagcaagactctgtatcaaaaaaaaaaaaaaaaaaaaaaaaaaaaaaaaaaaaaaaggtgttttggcctagattgagtaaaagaatatttacactattcttttctgtaaagcaaatcttactaataatagaaatcagtgggtgacattctgaaaccttatagataactgttatgatatccataatcagtgcttgtccttggattctgcatgggtagtgagctttaaagtatcttgttggtttaagatttaaccattttaataattttgaaaaccaagatggatgcatacattctgatgacaagaaaagatgttttgtaagggaaatgtggaattaaaatgaactttttgtgtttgtttgcaaataattattaatgttgaagaaattttgatgttagctctgagttatgaatgttagaatatatttagaaatgtttgattttcatttttccatgtcattaagaagcttgcatatgttttttaaagaattgccttctttttaatgtgttttctacaactaataggcttagaaatttcagacacaaaatctttgaaaaaatgacttgtacttacttagcgttttgttttgactaacacccctggtggttgttgaaccacaagttcatagtgttaaaagcctgtggtaaattacccagtaagctaagtgattaaagttgtttggaacattttgctcatgtacatcttatttttatgtgtatacatatttatagatctgtgctcataggactatagcactatattgcaaaggtcctaacctttattcacacaacttccagtgtgtacaatgtgacttgcagagctgtactgtggagcatatcctttcctgtgtcttttgtttacctctgagtaatgaagtcaaatcttacttgattttccttggctggtctattttattttattaagttctgggatacatgtgcgggactagctagtcttaaattcagtctttaggaaacgttttctgggctgggcacagtggctcatgcctgtaatctaagcactttgggaggccgaggcaggcggatcacttgaggtcaggagttcgaaatcaggctggccgacatgacgagaccctgtctctacaaaaaatataaaaattaacctggcatggtagtgttcgcctgtagtcccagctactcaggaggctgaggtgggaggattccttaagcccaggaattcgagaccagcctgggcaacacggcaaaaccccatgtctacaaaaaatataaaaattagctgggcatggttgtatgtacctgtagtcccagctactcgggaggctgaggccggaggattatttgagcccaggaggtggaggctgcagtgagctgtgattgtgccactatacgccagcctgggtaatggagccagagcctgtctcaaaaaagaaaaagaagaaaaggttttctgaagtttatgttaagtgtttgtacatgtgggaaaacagggaagaacagatcatctggggttttggacttttgaagatgggatgtttgaaagctcttttggttatgttattcgctattttttaaactttagatttagcctgaagcctaaaacttttagccaaggaaacaatgttttagtaaatggtgctgtaataaacaatagttggtaagtagtttacatgttaattttataatgatacattggaaatatctggcagaattagaatcaggctgtgtgtgtgtgtgtctgtgtgtgtgtgtgtgtgtgtgtgtgtaatcaggctggtctcgaactcctgacctcaagtgatccacccacctcagcctcccaaagtgctgggattacaggcatgagccactgcacctggccaggccatatatttttgaaacagacactttgatggactgtttttacttttatggggataaattcatttgaactttgtttaatacagtgattgcctgctctctctcccacacccttagggaagaatggtgtagttggcaaagaatggctttggaggaaaatctctttatgccatttctaaaatggaaatagtgcatttcttttcttgattagtaaaagggaaattaaagattatgagcatctcagaagaacactgaacaccaactctttatttttgccttccctcatttctctgagcgacagcctgagagttttatagtcatatgaggactctgaaaaatgttagagacctggctaagttgtaggtaactagtgcattgagaagactgaaaggctcctgaatgcagacaaagcattactaattgcattcagggtcaggctgtctttagccggaccatgaaagatacagcagcctgtctgctgagcggagactcttgtctttaagaaagactgctacctgatatgctagaccgtttcaggttgccctagtttacatgaatttagtcattatcgccaagactgctaaacctcagtgtgatacttctaaatggacttgaagacaaggtatttgaccttgcaatggggcataggcaacgttcatacagtttttaaaacacgaaacagaatactttgctatttgaagtttccgttaaaagattgaatgatttttaagatcgcaaagtaaacagcagacatacctttagaaatttttttatgacttgaacccaggaggcggaagttgcagtgatccgagatggcactactgcactccagcctgggcgacagagcaagaccttgtctcaaaaataataataataataatttaagctttaatagttctatcttttagatttatgaatgcttgccccttaaagggtaaggtgttaatagcagtactaatatacggtagtttagacctattccacaggcatagaccaaccagtgcaattaattcttcaacctcacaagtcctaatgttctaggtagaagtgtggctgaaattaaaactggttattagactttgtaatacaaaagtagaaaaaagtgatattagctaggtggtccaatatatttttgtctaagtaggaatctgaatattgtagaattgtacatttcggtgctgcttctagctattcctgttcttttttttttttcaaattgagatgagttttttttttttccatcaaagcttaagataacataggaattttatatggaagtactgttcccacagaactaactttacaaatgtaaagcttgggcagaggttgaggaaaatggtaaagtgatagatttcgtaaaaactgtagaaattttcattgactttactttgaaaatgtatagttgtacatgcgaaacgcttctagtattgcttctagatgtattattctgacaaagttccctaagtcttaaataagttctttttttttctaaacagacttatgaaaatatgcatcagtttaatactgtcttggaattcatgagatggaagcataggtcaaagctgtttggagaaaatcagaagtacagttttatctagccacatcttggaggtaaggaaaagaacataatttagaataatatgaaatttctcattttttaatagttgaaaataatccttctacactgcaactttatttgagccttcttcagtttctttgtaacaccacaactttatagtagcttctttagtttccttaatcatcttcctgacgagttcataagtaattctaatatatattcctcataaatgttgaacctcttcaggagtgaaaggtatttatttcttactaatcactttcataaatctccttttagaagataagcattaaatggtttatatgtttatttcttccccctaagtttgcaaagcagagttcagcatgcaagattaggccaggtgtgcctgtaatcccagcactttgggaggctgaggcaggtgggtcacatgaggccaggagttcgagaccagcctggccaacatggcgaaatctcgtctctactaaaaatgcagaaattagctgagcatgatggcctaagcctgtgatcccagccacctgggaggctgaggcatgagaattgcttgaacccagaatgcagaggttgtagtgagctgagatcatgccgctgtactccattctgggcaacagagtgagactctgtctcaaaaaaaaaaaaaaaaaaaaagattatattgaaaaatgaatgtttatgttattctgaaatttttacgctttttagaattcagaattttttttttttttaagacaggatcttgctttgtcacccaggctggactgcagtgagcatagtttcaactccctgggctcaagcgatccttctgcctcagtctcccacatagctgggactacaggcacacatcaccatgcccagctaatttattttttgtagaaacagggtctcattatccctctgtgttgctcaggctggtcttgaacccctggactcaagtgatcctcccacctcaacctcccaaagtgctgggattacaggcatgagctaccagacccagcccaggataagattttttaacatgttagaataatagatctttggaaatagaatttaaagaggtaggagctgccatcatgccagaaataggaggaaagaagccatcctaagacagtatgtacaggaaaatcaggcttactgttttaaaatccatttagagactaatgatcaggtaaaaggtttgaattatgtggggaatctacattttaagaaatagatagaatgtatggttttatgaagtggtctacgcttacacttctggaagtggcaggctttgcttgctgctactgttaatacttgcagcattcactcgcccttctcctgcccctgccaaaccgctggattagatcttctaaaaaataacgtaactctcgaattcttttgttaggtttcatattgtttgattggtagagttgtgatcgtttttttctttctcagttcttttggtttctatgattgtgtgctcttctgattctacttatttaattactccttgaccttttttccttcccctcctactcttaaataataatgaccttccccaaggttttatcttagaaattatcctgtttttttcttatgtctttcctagtctcatgatttccgcaattatctctaaaatgatctctctcaacttcctatctcagttgtggcattttctctaagcttcaggcccatattttcatctgtttacagatggctcagcttagtgcctcagacttcccattatctagcacatcattcatcatgagctctgcacccgctatttctccttctgttaatggacctctttgtcacccaggctcagagtctcagtgctgtttcggattcctcatcatttgcttcctacccttaggcacaagtgaagtcctgtcagttttacctctctaatgtatcacaaatgtttgaatcctctctttccgaatcccccttcaccatccaagtttaggtctttatgttacatctcactgaaaatattgcagggatctcccagcttgtgctgcttctcgctcctacttcattttacatgttgctgccagcttaaattatcttaagagataattttgcttgtattgtcggtgacactttgcctgtctgccagagtaaggacagattcctctaattttaaagatagtgtagctttgccttcatctgtccatttctttcaccctttaaacatttattaaacacctactgtatgccaggcactgtgttaggtcagaatgcaaaacattaaataaaaacaggttcctagctatactcaaaaaatagtctttctagggttggatgagcatgaaaacaattattgaagtgcaatctgagaagtgctatattataattgaaaagatatatttgattattccacactgtgtacatagatgataactataacatcactgatatgcccataattacatacagctataattttcaaaagaatttgaaaatacaggtgaccatgtcagaaaacaaaggtgtattggcatcacctggaaagactacaccaatgttatgagaggagagaattgtcaggcaggcttcacagaagagataatatttgagcagagtcttgatggatgaatagaagattgctgaatagaaattggaaagtgtaatactgtaaaatacatatgtgtttttgatgccatttcctggcattcaactcttaaaatccttgaaacctctgaagtgatgtctttttgtatgctaatgagttaactggtagatgacagccccctaggtagctttaggatgggggctggtcagcagaaagactaaggcaggattagagtcagaactttcagttcccgcccccaccaacccccaacatttagggaggggagaagggcgaaggttaagttgatcaccagtgacccgtggtttaattagttgtgcctacagaatgaacgttccataaaaatccaaaagaactgggttcagagagcttctggatagctgaacatgtgcaggctctggtgccctgtacatctctttatctgtcctttgtaacatcccctataataaacctgtaaacataaatgtttccttgaattctgtcagccgctctaagcaaactaatagaacctgaaaaaggggttgtgggtacctggatttatggctggttggtcagaagcacaggtaaaataacctgggcttgccattggcattggaagtgggggccgtcttgaggatggatccctcaacctgtgggatctgatgctgtctccaggtgggtagtgtcggaatttaattggaggttccagctggtgtctgatgcagaattgtctgcttgcttgttgatggggagaaaccctcacacatttggtaagaaaagtcttccctgttgattgttttggtgagagggcagaggaaaaatagtttgagtgttttccatactcacagaaggcaagggaattaatttcatgcagagcccagagcggggtggaggcagagcttgaaagtgtatagaatgtacagaagatagaataatttttgtatggcttgaatttagaataggagagagagtttgagggacaaggctggaaaggaccttatgaagaattttgaatgccatggcaaggagtctagactttattttgtgaaaaatgggcagtcattgaaaaattttaacatttaaagatattttggatcgtaattttttgttaaaattaatatgatggttgtgttagtcagttttcatgctgctgacaaagacatacccaagactgggcaatttgtaaaggaaagaggtttaatggactcatagttccatgtggctagagaggccttacaatcatggcagaaggtgaaaggcacatcttaggtggcagcaggcagagagaatgagagccaagtgaaaggggaaacctcttacaaaatcatcagatcttgtgagacgtattcactaccaagagaacagtataggggaaactgcccccatgattcaattatttcccactgggtccctcccacaacatgggggaattatgggagctacaattcaagaggagatttgggtggggacacagccaaaccatatcgttggtgatatgaatggtagtttggaaaaaggaaaaactaaaactagagagacaagttaggctattcttaactgtttcaagcaagaaataatgaagctgtcaacttaagatggaggtcaacttacccgtttaagcattggttgtttagaaaatgtttaattttcttctattcccctatgtactatactcttcagctggtgatttgaaatcgtccttccttttctctactctcttctcttggcatatttttggccctttctctcttgtggagtgcctgtgaactttaaaaaccccatctcaaatgccaattcatccctaaagttctttctaatctgtattgctttgactctaaatatatgtcttttcctagtctaaagcccccaaagcacttatttttattctacaggatattacttttttggtccctattaaactatgtggcagcaagtcacaaaggaggaatcagaaagtaacctgctccccacccttggtgtgtagtccagttagcaaggtatgtatataagtaatataagtaatgataaccaacattgccatgcaaaagtgaggaatgccacaggagtaaattgttgcttctagtcagagtcctgtaactgagaagcacaggtagaacataggaggttatgtgagctgagctttgaaagatgagtaaaatttagatgggtaaaggatatttctggaaaagtgcatggatagaaaatgaatgtttttgtaggaatgtggtgaaggtcttagaaagggcaggaagtatgatgtgaagaaagctcttttagtgaaattactctagcagtgacatataaactatacatcattagagaaatgaagtgaggaggtagggagccgagtgaggagattgtggcactagttaggcataagctgatcagaattcaatcagggtggtgattgtggaaatagaaaagaaagactcaatgataaaggtattgcggcagaagaagggacaccgatgtgtgactagatgttggaaagagatgatgccgcctgaattttgagcctggatggtggggataatgttggcctcattagtagccaaggtaagttggatcctacttttctaaatgtagagaaacattaaaatttatgttttactgtactgttggtctcttaatttgtttatgtgcaacaagtttttttggcattatttttccagccttaacatattcaaagggagattttatgaaaaaagcaaagtatgacctcttttacaaaagcagtttttaaggaaataaactgtattctgttcatagttacctcttttgctatcatgttaaatgctatgtaagatttagtaaaacttaagaatgtttaaagtatttctacaggtataattcagacaccattaccaaaggatggtatcttgttttaatagaattaccgcttaaggaatggggacctgtgaaaaattcattcagtagaattcgatggttccatattaacagataggcattattatggtactgtccattagagaaatattgtacagtaaggcagtaagttaattatataaaactggcttttaaaatgcatttattaaaattcttatcaactgttaactgatgactgatttagaactttgcaatatttagaaacagtctaatactctctgttgaaaataatcactaattgttttataattataattatacatgtgtaaaactggaagacattacattattgaggaaggaaggcatttgtgttttgtttgttttttaagtcaggctttgtgttgaactattattttttatttatttatttatttagatggagtttcactcttgttgcccaggctggagtgcaatggcacaatcttggctcactgcaacttctgtctcctgggttcaagtggttctcctgcctcagcctcccgagaggctgggattacaggcacccgccaccacgctcagctaattttgtatttttagtagagatgaggtttcgccatgttggccaggctggtcttgaacacctgacctcaggtgatctgcccacctcagcctcccaaagtgagccactgtgcccagtgcagcatactctgtttacaagcacaagcagtgtagccagaggacttcagtttgaatcttgactttaccacttagtttgtgttcccttgaaagaagagcctgagaaaaagacttactggctgataggttatttgggagatgaaccaaaaagcagaagtgagagaatgggaaaagtgagacagagaagggagtgaagtttcattaagtgggtgatccagttccccctgcgggcagctgggcttcagccctgtgggtgtcttctgaatgtacctcactgttgtcccaccaaaggacagggagcctgagacatgcatgcaccaactttcacctgttgttaattgaaggttgctccgtgagctttaactccggcaggtctgtgcttgtgcctccatgctgttgagcagtctcccttaggtttgcaaagtctccgaggaacaaaacagagcagtgcctccactcccacttgagtcaggtgctgtgcatgccacatagacctgcccaccagagccacagtgcggagaggggtgagctgcagagcaccacgaaggtctgctgtggtctgccccttttaccagtgagactccctcatgccccattagatctactctgtcactgaccctgcagattggtggctgattatgatcactaaaagaaatatctaacaggtgcagtggctcacgcctgtaatcccagcactttgggaggctgaggcgagtggatcatgaggtcaggagatcgagaccatcctggctaacatggtgaaaccccgtctctactaaaaatacaaaaaattagccgggtgtgatggcgggcgcctgtagtcccagctactcgggaggctgaggcaggagaatggcgtggactcgggaggtggagcttgcagtgagccaagatcgtgccactgcactccagcctgggtgacagagcgagactccgtctcaaaaaaaaaaaaattatatatatatagatatatgtatatatctctgaaacaagagggttaaaatccctaccactgcagctggtcctgagctcttatttccatccttgacattcatatgagaatgctctaagagccctcagttgtgctggcagtagggtgttctctgggtagggaaggcaagcccgcatctggagtgttggttctgcaccctccttgttagctggcatttggcagtggcagtagttaggtcacccttcataagaaggagcccatgctgttgggcctatgtagagccttcctctctgtcactccacaggctccattgacgggcctggtactccagccttgggaagaagctggctgacagcactgacaagccatcctgtctgtccttggggtgtagttgaatgcctcttctgtgggaggtgccttgtgttgggcattcacataagataaagattggcactttgtgttccctgccttagggccgtcagcgtgcctcttctccaggcttctggtctcttatttcctttttggacccttttaatacaaaaattagccgggcatggtggtacatgcctgtaatcctagctactcgggaggctgaggcaggagaatggcatgaaccctggaggtggaggttgcagtgagccaagattgcgccactgcacttcagcctgggcgacgaagcaagactctgtcccccgccgcccacacacacacaaaaaaaattaaccacacacccacttgcttctgtagagaaacctagaactcctggtctcagaaatgtcatccaggtctcgctttcaggctttttgattattctgcaactccagaaaaagaggctgtttagtcccactctcttccattcagactgtctcctcttaagttttaaagatactattattttttcttaatttaagcttagcggatttacttctggttttgatccctctccagtttgggtgctttaattttatttatttatttatttagaggtggagtctcgctctgctctctgctaatttttgtatttttagtagagatggggtttcacaatgttggccaggctggtcttgaattcctgacctcaagtgatctacccaccttgtcctcccaaagtgctgggattacagacgtgagcccctgcgcctggcccatttggggtacttttagatgcagacggtggtttgggaacttgcagctccatatggtatagtggggagagcatgccacaaggttttcaggtaatatgaggttttctcctcatattctcttactacacttcaattcctaactttatcttccagcctaataatttctctcttgcactactgtcttatggtttcaactgtgaaaggtaatttccagtctcggtgtcacagatactccagtttaacctctgattatatcttatgtattctttcttccttccttttgtttctcccttccctgctctgtcttttatagggcaggggttagggaacgtctcattgccccttttgtttttctttttcctcattgcctctttttaaaatgatcttttttttatttttaaaagattatatattggccaggcacggtggctcatgcctgtaatgccaacactctgggaggccaaggtgggaggattgcttgaggccaggagttcgagaccccatctctatttaaaaatacacacacacgtgtgtatgtgtgtgtataaagattatgtaagcagcctattaataagttcctatataaaattttaaacactatgcaccaaagccttttagtccctcttccccacccttcaccccattgccctcctcaccaccctccttgccctccatcccactgccatcttggggacctctgtttcttaggttattggtctgtttgtgtattccattccctgttgagttaatttttgtattaatatctttatagaaaatgatacttttttttttttttgagatagagtctccatctgtcgcccaagttggagtacagtggtgccatcttggctcactgcacccttcgccccccgggttcaagcaattctcctgcctcagcctcccaagtagctgggactacaggcgcctgccaccacacctggctaaagttttgtagttttagtagagatggggcttcatcatgttggtcaggctggtcttgaactcccgacctcaaggccgaactgccttggcctcccaaagtgctgggattacaggcgtgagccaccacgcctggtccatacagttattcttgattttcagatttattcttataaaattatgcctaatgagaatatccctctcataaagttagtgtgaagattaaggaatttaacatatgaagtatgtagaacagtgcctggcctatagagctctaagtgttaactattatttaatattattatgcttgaatatttataattatttttggtaggcctccttgtacttcgtattatttatttgttctttatttttgtgcttagacttcctagggatattgaactttctagataatttcatgggtcttttcaaagagccagcattttggttttataaattaactccacttttttgttatatatttaataatttttgcttttaacatactaccttttcttcctgcctttggtacccattcttccatctcggttacacataatattcttctatttttaaacatttttctgttgtttctgaggatttaggagcagtaggaacacatttgtttattctcccagccttagttagagctgcttgtatattttcaaaagcttcttgcacctctgtctcctgatggtctgtaatttttccagcaacccaggatttaaatctgggaaccacctatgacaactgcatctctgctttctatcagatctagaagttgctaaattttatcagccccccctctataatagttttcttccacttccctattctcattgcctcttggttgggatggttacttcttgtgtgaactactgtaattaccctttggcttatctacctcaccctgtccctttcatcccatgtaatgcttcaagagtgatttttctaaaccatggtgcactcacttctttgctctgaaacctccagtgatttctccttgtctgctgagtaaagttcaggctactttacactagcatttgagaatcttatgaattaattcctgcctacacttaatcattctttattcctttgttctttaggaaaaatcgtaattggtaagataaaccaaatataaaactatatagtaatgctgtttttcagtcttactgatctcactctattccttatctttaccatgcttttctgactttgtgcttttgcctctggatttcccagtctggaatgcctctctcacatcctagtatgttgaaatctgtccattattcaagtgtgagcttagatgccaacactttgatgaaggcttatctgatcccattgcctagaattaatcttctcttcccatgtctttggatttgaactgcagcttctgtgctctgttactagtcattccattttcgatagtctaccagtaacttctgtgccttagatccacatttacactggcttgtcaggattggtcagtgaatcaaataggtagtaagtataagcttctagaactacactctccgatatggttgtcattagccacttgtattttgactactgagtagccacatatggttagtggctactttattgagtaacatagagactttcatgattgcagaaagttattttgagcagtatctagaacaatgcctggcaaataatagacaccagggaatgttgttcctaggtatcacatcctcatagtagacactcagtaaatattagtttaactttcctttcctcatctgaattttattagcgtttacctgtgccatttaaaaagtaacagtttatggcagctaacacagtgtatgaacaataaatatattttgggtgagtaagtaaatactacgaagcatccagaaagcatcttgctctcttttggggtggggagagtaggggagtggaagttaaaaaaaattcactactcaggccgggtgcagtggctcatgcctgtaatcccagcactttggaaggccgaggtgggtggatcacttgaggtcaggagtttgagaccagcctggccaatatggtgaaaccccatctctactaaaaatacaaaaattagccaggcatggtggtgcatgccagtaattccagctccttgggaggctgaggcaggagaatggcttgaacctgggaagcggaggttgcagtgagctgagatagcgccaccgcactccagcctgggtgacagagcggactccatttcaaaaaaaaaaaaacagttcattgctcaataagtgaatatttccaggatgcttaaattaaacagggtagactaagcagctaaataaaggtggtcttatctactgcttttcaaatttagtgtacgcgcatgtcacctgggggtcttgttagaagattctaattcagcacggtctgggattctgcatttctagccagcttgcaagctagccagctctgcccagtgagggtgtaattcactagattggctacttaaacccattttaacatttcctagtctttagaactagtcctttaatttagctcaaagttttgttgttgttgttgttgttttgagacagggtcttgctctgttgcccaggctggagtgcagtggcatgatcatgactcaccacagccttgaactcctgggctcaagtgatcctcctgcctcagcctcctaaagtgctgagatggattacaggcatgagccaccacacctggcctaaagttctcctttttgaggtgataatttttaaagacagcccttatatgttcaggaaatataagcctgtttttacataaagtaggtgcattgttcagtaccaatatgagaaagaattatgaatacagctttatattattagatttcttatgtcataatataaaaaaccggtaaacttagcgctgaactattcatgatagttgaaagttttaagctaattcaaaatatgaaataaaccagaaatattttggaaagaagaggttttaagtatattcaggtcctccattttatgatgtgagtctaaatttctgttctctgatgtctagaaatcacaaaaggatggtgattttgggaacgaagttcttgagctagcactgtcagtagtaactggccgttactgtaagatctagagatatatttttagatgccattatacttacaaagaactgttagagtgcattttatggttttatggttggtttaattccccaaatatattgcccttagcaagttattactattttttatttcttaaatttatttattgaacatttttattcctttgtttagaaatgtgctagacagtggcaattacattgctgcaagataagtaaaaaaatcagctgactaagctttataagaggaggaatcatgtctcttttatttaccgttggatagtcactacatggcacataaccaagtcatcattaagtcatttttgagtgaacattgctcaagatctgcaaagcagctgtgatgtgtgcggggtgtactggaagttgaacgggactcctcaagcagcctaatgagttgggattgaggattgcatacacaagggaactcgcagatcaagtcctgaagagaacattgtagttactctggcaaagaacaacgaagacacaaaagctgtgcagagtaatggaagcctggaaggagtgcctgtgaagggagagcggctgcactgactttggtagagttggagcatcgtaagggtatggaggagaggggaggagagtagtagaggtctcagcagttgtcagatgacaaaaagtcttgcgttactaattttatcgtatgaaatgaggatattttttaggtttttaagcagagagaatggcaaggtcatttggttttagaagttagtccgagctaggcatggtgacagatgcctgtactggacaagctgaggcaggaggatggcttgagcccaggagctggaagctgcagtgagcagtgatcacatcactgcagtccagcctgggcaacagagcaagaccttgcctttaaaaaagaaaagtctgaaatacccctcacaactgttaaaaaaaaaaaaaagttctttcaagcacacgtggagtgttttatgaaagtgaccatttactaggctatacagcaagttcttatacatttcaaataaaatcaaccatgttttctggcgagaaagcatgtaggaagtgaataacaaactgtacacattgggaaatttaaaaacacacttctgtaaatcccacagattaaatataaaataatcaatttagtgaacacctagaacaaaacaatagagaaaataacagcctgagcaaaatagtgagaccctgcgtctacaaaaaaaaataaaaattagcccggcacagtggtgtccccctgtagcccctactcagaaagctgagatgggaggattacttgagcctgcaaagttgagtctgcagtgagccatgataacaccattacactctagcctggactacagagcgcaagaccttatttcaaagaaaaagaaacttaggacatattaaaacgtgtgtgaaaccctgaagccttaaatattcatatttgaaaagaagattttaatactaataagctaatctaagttagggaaagagcatggcagtaaattcaagtgaagtaaaatagagaatacagataaaagctaacaattctagagttcttactctattccaagcaccgttccatgttctttacaaaggttatctcatttaatcttcacaaagccatatgaggagggtattgttattatgtgcactttacacaagaggaaacttaggcacagagagaaacttatccaagcctctagctaataaatgtgatagaattggggcttgaaatgatgaattttttaaaaaaagatacattgaagaggattaacagagctgaaagttgttttttatgaaaggctaataaactatttgaaagattgatcaagaaaaaatataaagtacaaataatactgaggatataaaaggaagatacagaagaaagtcttaaaaataaaatatcttgaatcactttataccaataaattttacaatttaaacgtcaattttctagaaaattataacaatgaaaattgacacagagtaaatagaaaacctggatatttctgtaactgttagagaaattggatttgtaattaaaagaaccacccactttcatatattcagagataagcctttggcccagatgatctttttttctaagaaaaaaaaaaacaggcctcttcagagacttcatttattatatgaagaattagtgaaaactttgtcccaccattttaggctatttttacattagaaaaaatactgcacatttatgaaaatttactaggggcaaatttcaacttatctgtaaaatagtaatgccaactgtggagatggcactgtaaaccaaaaggcacaatgactaaagaaactactgaaaatttaacaattatctcttcattatccttccttattggggaacctgccccgatagtcatgtaggttcttttctattttccgtaagtgttggctggttagagaaataaagggacagagtacaaaagagagaaattttaaagctgggcgtccgggggagacatcacatgtcggtagattccgtgatgccccacaagccgtgaaaccagcaattttttattagtgattttcaaaaggggagggagtgtgcaaataggtgtgggtcacagagatcacgtgcttcacaaggtaatagaatatcacaaggcaaatggaggcagggcgagatcacaggaccacaggacggggcgaaattaaaattgctaatgaagtttcgggcaccattgtcattgataacatcttatcaggagacagggtttgagagcaaccagtctgaccaaaatttattaggcgggaatttccttgtcctaataagcctgggagcgctatgggagactagggcttatttcatccctacagtctcgaccatagaagacggccacacccaaggggaccatttcagaggcccaccctcaggggcacattctctttcccagggatgttccttgctgagaaaaagaattcagcaatatttctcctatttgcttttgaaagaagagcaatatggctctgttccgcccggctcaccggcggtcagagtttaaggttctctctcttattccctgaacattgctgttaccctgttcttttttcaaggtgcccagatttcatattgttcaaacacacgtgctctacaatttgtgcagttaacgcaattattacagggtcctgaggtgacatacatcctcctcagctgacaggattaagagattaaagtaaagacaagcataggaaatcacaagggtattgattgaggaagtgataagtgtccatgaaatcttcacaatttgtgtttagagactgcagtaaagacaggcataagaaattacaaaagtattaatttggggaactaataaatgtccatgaaatcttcacaatccatgttcttctgccatggctttagccagtccctccgtttggggtccctgacttcccgcaacacttcctgctccaagatttgctatgatgagttttccaaatgttaacgacctggaaaagctcattgtctttaagacgtatcccttctgagtcttgtgatttggtggtttcttcatccaaaacgtatcatcctctataaaactccctgatcctcagatttaacttttcagtttctttttccaagttctcatcagtggtttaatggctgtatctgagcacctaaaaggtaaagactcttccaagctgttgagactccctccaggcaggggaatgactatctgggtctgagattatgtcattaagttctttttttttctttttctttttttttttttttctttttgagacagagtctccctctgttgcccaggctgggatgcagtggtgcaacctccactccctgcaacctcagctgcttgggttcaagcagttctcctcagcctcccaagtagctgggattacaggcacctgcctccacgcccagctaattattgtatttttagtagagacagggtttcacatcaggtctcgaactcctgacatcaggtgatcaacctgctgggattacaggcgtgagccaccacaccctgcgtcgctaagttttttaaccagagaggcttcaggtttcagacacacagaagcataattctggccatacaaaaacctcagtttcttctgtcttccacccaatcaaagtctccttcaaaactttaagtaagtttctatttgccacttcaggacacacctgcactgaactagacactgacttagaaacttggtttgatttggcaaattttctgttaaaatgctccatacttttcttatgcctattagagttatttctgacctactgtatttactttcagaattttctgaagctataatctttcaggaaatagtactattttttgaaatagtatttctattttttgaaaatagtatttctattttttgaaatagtacttttcaaaaaagtactatttgaagaactcttgagtatttactttctgtaaaggaagttcacatgtggcagctttctcctgagtatctaatttgcaattgcctaactgctcagtgacatccactactgtctgttctttgtgtttggcattagctttgagaccagctttctttttcattatgcttttttggtgcagctgtcgtctaatacttgttgaatttggtctgtttcctggtagaatggaggaaacaaagtcttgctcattatcactgctgctgtcattatgagtgctggaagaacaattgctagaagattcatattgcttttcaaactggctaggattgttgatatctgatgttttaatggctttactgcataactatttcttttccagaatggccactttgcccttcctttagcagttgaaaatctggatgcctctcaccgtactggagttttgggaatttgtgcttcaaaaaactcagatgcttcataacaaaaattgctgcaaaaagactttctttcagtaatatcatagactttattggttttgaaattttatatttaattcccagcttcttgtgacataaaggataaccacagagtttgacaatagaatgttcattcactacatcgttgtagtgagcaggtgtaatgaacttccccttttagaagcatcttcttgtttcaaagtacttgtctgtttagtacctgtggcatttcgagaatggtgggagccctggccctctgcagcccagggcagtcagccatgggagagagtagtctgcgggtctggaccagctccagagtctcgccccgaggcaccatctccctacctggcccacgttatcttaagggtgaattcttttaaactgtccatgtcgtaggtatgtccagatttacacatgccattccagagaatagcaaattaaggaaagttcctcagtttattgtgactagtataactttggtaccaaaaccaagcatggctaatatgaaataaattatagaccagtcttgcttgtgtaaaatctaacaagataggagcaaaagaagtccagtattatgtttaaatattttatatgtatatatctcatgtctacaatgctgactgtaatacagttctgacagagttagcatgaaactccacaggtttaagggtgcagttcccaacgagactgcccttgctgcgagtacaagttaaaagtttggtggtccccagaccacctgttattccgattaactggctgcaaatctgggggttcccatgaatcccctcaagtttgataatttataaattaactgactgaacttgggaaagtggtatacttaagttacactttaattatgaagaatacagatcaggaccagccaaatgagatacagggtactgggagggttcctaacatggagcttctgtgctctcttctcctgggatcagggtatgtcaccctcttgacacatcagtatgctcaccaatgaggaagcctacctgagctatggtgtgtgtagattttatatgtaggtgtaatggaataattggccatgtgattgaactcaaactttcagtgttctctcctttcttccttagaggcttggctagctcaaaccccatccttctacacatggtggcctttctggtgagcagaccccattctgagtcatcttgttagcataatctcccccattctgagtcaattgttagcataatctcaggaatgatccatgaggctcgtgagtaacaaaggcattcctactaccaaggaaattccatgaattagaggttctctcccaagaactagggtcaaagactgaatacattatttattatacaataatgacaaattgaaattatcccaggaatgcaagataagtgtgttaattatcattgctgcataacagtttatcccaaaacttaatgacatgaaaccctaatttacaagaattcaggagtagcctagctggatgtggttctaatctttatgtttcacaaggttgcagtcaggaagtcagcaggggctacagtcatctgaaagcctgactcggggagaatacacttccatgtggcatactcacatggtggttggcaggaggcctcagttcttcaccctatgggccttcccataggctcgagtatcctcacactgtgacagctggctttctccagatctagtgatccaaaaaaaaaaaaaaaacaaggagaaagctgcagtgccttttaagacctagtcattactttattcgtttctttttttttttaaattaaattgagatggggtcttgctatgttgaccaggctggtctcaaactcctggtctcaagcagtcctcctgcctgttcctcccaaagtgctgttattacaggcagaagcctgtagtttttcctgtatcctgtttgttagaagaagtcactcagtttaacctatactcaaaggaattagtttccacctcttaaaaagaagagtatgaaagagtttgtggacatatttaaaaaccaccacagatggtttattcagtaaagttcttaatatgaattagtattaatttattaattcatttgcacattttgaaggagaaaaactctgtgctcatatcactagatgaagcaaaagcacttgatgaaatttaactccatgatgaaacctctcagcaaactaggaagggaacttccttaatgtgataaagactttcattaaatttataattaatttaggaacagttgacataccttatattgaagctttctgtacgtaatatgattcatctatttgttaaacttattattttgttcttcagtattttaaaattgtgtttatatcagtgttttacatttggaattgcaaaatgatatagtgaaagatgaagactggaagtcctagctagagcaattaggcaagagaaggaaataaagggcatctaaattggaaaggaggaagtcgaattgccacgatcatatatatatgtggaaaaccctaaaaacttcaccataaaacttttagaactgataaatgaatttagtaaggttgcagagtacaaaatcaatatacaaaaattagtagtgtttctatacaccaataatgaactagcagaaaaagaagagagtaatccatttacaaaagctaccaaaaaatgaaatacatttgaccaaggaggtgaaagatctctacaaggaaaactataaaacactgatgaaggaaattgaagcgggcacaaaatatggaaagacatccatattcaaggatttgaagaattaatactgtgaaaatgaccatactaccaaaagcaagctatagattcaatgcaatccctatcaaaataccagtgacagtcttcatagaaatagaaaaaaaatcctaaaattaatataggaccataaaggactgcaaatgccaaagcggttctgagccaaaaggacaaagctagaggcatcacactaccagacttcaagatatactgcaaagctgtagtaactgaaacagcatggtactagcataaaaccagacagtagaccaattgaacagaatagagaacctagaaataaatccacatatttatagccagctggcaaaggcgccaagaacatgctttggggaaaagacagtcttcaataaatggtgctgggaaaactggatatacatatgcagagtgaaactgtacccctgtctttcaccatatacaaaaataaactcaaaatggattaaagacttaaatgtaagacaaaggcaccaaagacaaagtgaatcatctattttcttttattattattattttttgaagtatagagatggggtctcactacattgcccaggctggtctcaaactcctgggctcaagtgatcctcctgccttggcctctcaaagtgctggggttataggtgtgagccattagcgcccagctaaatactgtattttcagcccatgtttgcctgcaatatgaagagattgctatacttattgaaaagaagagaccggaagtggtggttcatgcctgtaatcccagcactttggaaggctgaggcaggtggatcacctgaggtcaggagttcgagaccagcctggccaacgccatctctactaaaaatataaaaattaaccaggcttgctggcatgcgcctgtagtcccagctactcgggaggctgaggcaggagaatctcttgaacctgggaggcggaggttgcagtgagccaagattgcgccactgcactccagcctgggcgacagagtgagactcgtctcaaaaaacaaaaagaacttgcatataaattgacccatgcagttccaacctgtattgttcaaaaaaaccaaaacctcccttagacctagaatcccacttctgcaaatccagcctacagttttatcagcccaaacaacaacaaaagcatctcttcaagtttatttattgccgcattgcttatactaaattattggaaatgatctaaaatgtccatcaacatggttgtgcactgtggcatgcacctgtagttgggactgctcgggaggccgaagcagtgcaatctgattgcacctgtgaatagctcctgcactccagcctggaccagcatggcaagaccctatctctaagaagaaaatgttcatcaacgagaatgagcaaatatgaccataagatatttataggataaaacactagataacaatgaaaatgaattaagaagaactacaagtatctatcatggaaatacttcacagtgttatgtgaacaaaattaaagcattatatatataaaaacagtaaagtttttatatatctgtagaaagtttaacaatatgtaaggcaatgctatatgttacttaacaatcctttctttgaaataaaaggcaagttgatgtgtgtttaaactagaaatcccaggaaaaaatcagaaaggtacctgggcttaaagaaaaatgctaaacggggctgggcgccatgactcacacctgtaattccagcagtttgggaggccgaagctggtggatcacccgagatcaagagttcgagaccatcctagccaacatggcaaaaccctgtctctactaaaaatacaaaaattggccaagtgtggtggcatgtgcctgtagtcccagctactcgggaggctgaggcaggagaattgcttgaacctgggaggcggaggttgcagtgacccgagattgtgccattgcactacagcctgggcaacagaatgagactccatatcaaaaaaaaaaaaaaagatgctaaaaggaaagcagggacaagtaaatgtcaaatccatttcatgccatagaacttttttttttttttttttgaggcggagtctcgctctgccgcccaggctggagtgcagtggcatgatctcggctcactgcaagctccacctcccgggttcatgccattctcctgcctcagcctccccagtagctgggactacaggcgcccgccaccacgcccggctaatgttttgtatttttagtagagacagggtttcaccatgttagccaggatggtctcaatctcctgaccttgtgatccgccatccttggcctcccaaagtgctgggattacaggcgtgagccaccgcgcctggcctagaacttcttacaacaccctaaaccagtacatttcaacctgaaaagatgttgtaacgcagaataaagaaaataaagtacagatatttcattcccaaggcggggaactcttctaggttcccaagttcttgagcttcacgtgcatacagcaggaatctgtcatcttgagggagttctttcttaaacctatgggtttgtaagattttagttttctatgctgtccttttttggtcatgcttgtcagggaagaattgttaaaaatctattttaacaccctctgcccttattcagggcagttagagacttaaattttacgtacacatactacctttgaaccttcagtgtgttgtttatgtactgaaagattgcagttgaatttagatcatgctttgaagttccctttgtcagaccacattgtttgtacccaaagaaagacttcattttctttttgtctgtaattatttccatacttatttaacttggtataacatgtggtactgtaaaagcataacccaagccattgtttgccttaagcaacattttagacattttagatttggggatgtggtgtttacttatacaagcctttcttaagcccttttaatttatatctcaaacttgaggatatccatgaaaacagcggaaactttttcctcaccggatcttgacacaagtcagggatggaagtgagcaaaaggaagtggtgtggtttttatatcatttcagttgtgttgagatagggaaatgggatagtttatccactgtactgctcttttgggaaagtctggtttgtatataaaagtgaaaggaattggcataatgttttaatttcttctgctccattcagtcattccctcaataaatatttatttagtatcgactctgtgccaggcactgttccaggtgctaaaaatataaagtgagtgaaacagactaaccctcctggcctcatggagcatatattctagagcaggtggcaggcaataaaatacagaaaaattatatcaaattatatagcatgacaaatgctaaagagaaagaaacagccagaaaggagaggagtgctaggcatggggatgggattacagttttaaatagggtgggcaggaagcctgtaaataagaaagggattttgagtaagtgcttggaaggggcaaggcagcagtcccggggaagaccattacaggcatagggatctgcacgtgccagggtcctgcagcaggactgtgagcggcaggtgcaaggaacacctattaggctggaacggagggagggtggaccactggagactttagctttttgtctgagtgagttggagcaccgttggagggatctgaatggggtgtgatgtggtttaacatgctttctcttaggatcactctggctgctgtgttgcaaatccatagtgggcacaggtggaagcaggaggccagttaggaggtgccttcagcaatccaggcaaaggggttagtggcttggtccagagcgagcagtggaggtagtaggaagtgtgtgggttctggacagattctgcaggtacaaccagtggatttgatgacaggaaatggaatgcaagaaggaaagagggagttgtcaagaatgacttgagattttaggcctggttacatcagtgtagcgatattctaaaaataaaaaaaaaaagattttagacctgggacttttaagattttacaccaagtaaagaggctgtcaacggaggtgggaaagacttaggatctagcaaatttgggagggaagaggcaaggaaagataaatagtgacaaattgtatagttgctgataacattgttaagtcaatatttatactatttgagctgcctttttttttttttccccctctgagacagtctcgctttgtcgcccaggctggaatgcagtggcacagtctcagctcactgcaacctctacctcccaggttcaagcagttctcctacctcggcctcaagtagctgggattacaggcacccaccaccaggcctggctaatttctgtatttttagtagagatggggtttcactatgttagccaggctggtcttgaactccccgcctcaagtgatctgcctgcctcagcctcccaaagtgctgggattacagacgagagccactgtgcgggccttagctgtcttaaaaatagcacttatagcagcctgtgttttcttttcagatgttatcaagtatcttttctggtaagacatttatttgcctttattcagaattgctaattttatgctaatctaacccagaatactcaagtgtgcctttccctttaatcctcatattagctatattagctagaatatttttggttgtaacagaaaaattgactctctctgacctaaaaaatggaatttattggctcttaagagttccaaagtaattgaggcttcagacaaggttgcttgagtggctcatcgatgtctcccgggatctggcttctttcagtctcctggctctgccttctggttctccttctgggcccaacatagctgccagcagtttctgggactgccttattcatattgagtctgagagagtgactttgtcactgcagggtcagtcaaagtcctgagactattagaccagctcgcccctgaactttttgtggcagggaagatagaatatgcttagtgtaagagcctctactcctgagatcttaggggaaatctttgtaccctgaattaaaaaaaatttttaaatagttacataagtggaaatgattgatttttaaaaattgcttttgcattgtacaagcaccatggttaacaaaacaattcctttttaaagcagtcaggtgggaagggaaaaaaagtaaaattgtattcatacattagtttgatcaagataatttttcttcttagagatttaatagtgttgccacttgaccagctggaactacaaaggaaccattagatagtaatgaagtatgatacccttttcagcactccttctcacctttttactttacatctccagttttgcctcgcacaaggtctcttcttcctctgtggatcctctacctacatgtgtctacctgctaattagacaggcacatgcacactagttttctttatccccaaaattcagtttgcaaatgggaccgaagagctccctgttcccctcatgacaccgacacgacaaaaaaaagttattccactaattcccttgatggtcggtttaggagtttctgcctccactattgctctcggtactggaataacaggcatttcaacctctgtcacgaccttccgtagcctgtctaatgacttctctgctagcatcacagacatatcacaaactttatcagtcctccaggccctagttgactcttcagctgcagttgtcctccaaggacaactccgaggccttgacttactcactgctgaaaaaggaggactctgtatattcttaaatgaagagtgttgtttttacctaaatcaatctggcctagtgtatgacaacataaaaaaactcaaggatagagcccaaaaacttgccaaccaagcaagtaattatgctgaatccccttgggcactctctaattggatgtcctgggtctcccaattctgtcctttaatacccatttttctacttcttttattgggaccttgtagtttctcaattcatccaaaaccgtatccaggccatcaccagtcattctatacgacaaatgtttcttctaacaatcccacaatatcaccccttaccacaagatctcccttcagcttaatctctcccactctaggttcccacgccgcccctaatcccgcttgaagcagccctgagaaacaccgcccattctctctccataccaccccccaaaaattttcgccgccccaacacttcaacactattttgttttatttttcctattaatataagaaggcgggaatgtcaggcctctgagcccaagccgagccatcgtatcccctgtgacttgcacatatacgcccagatggcctgaagtaactgaagaatcacaaaagaatgaatatgccctgccccaccttaactgatgacattccaccacaaaagaagtgtaaatggccggtccatgccttaactgatgacattccaccacaaaagaagtgaaaatggccagtccttgccttaactgatgatattccaccacaaaagaagtgaaaatggccagtccttgccttaagtgatgacattaccttgtgaaagtccttttcctggctcatcctggctcaaaaagctcccccactgagcaccttgcgacccccactctgcccgccagagaacaactcctctttgactgtaattttcctttatctacccaaatcctataaaacggccccaccctcatctcccttcgctgactctcttttaggactcagcccgcctgcacccaggtgattaaaagcttttattgctcacacaaagcctgtttagtggtctcttcacacagacgcacatgaaactaggcaagaatcagtgtttctctacaaattgagttgacaaaaagaaattatcttcccctgcccccacaaaaaaagaaccagtatttctcaacaaggagagtactgttagcatttggttctttattttgaaggattgtccctgcacattgcattttctatcctggtccctggtcaaactgtatgtcctgtcatatcccagacattattccaaccaaaaagtcacctacatatttttagatcctcttaggagggggtggtaacccagccactgctgatgcctgaggggagtgcaaagctgggtttttgaggagctgggactgagatcctgagtagtaggcaccactgggcctaaaaggattccatggggttggttctgggagtgtggaaggaagcagagagtgtagattgctgctgccaattgaatgccagtggcattcaggcaactgacaggaacagcgaaccaaattgggaaaaagaaagtcccttctcccctcttccagctttctctagttccccagttggcagagcctctccaggaaccagctggtgaaggacatattgtcagcagcatcccagctccagcatcagaaagcagaatctatagatagaagagggagctttttttttttttttttggctgaaaagcgatagtgtaaaaagggacacagtactttctgttttttaatctcattactttcctgccagcgccttaacatgcagtaacaagtggaatttgggctttgtcagcagcaaacctgccacttactggttgtgttaagttgggcaagtttctttctttttttttttttttttttttttttttgagatggagtctcgcactgtcacctgagctggagtgcagtggtgtgatcttggctcactgcaatttctacctcctgggttcaagtgattcttctgcctcagcctcctgagtagctgggtttgcaggtgcctgccaccacgcctggctaattttttgtatttttagtagagacagggttttactatgttggccaggctggtctcgaacgcctgacctcgtgagccaccatgcccggccaactcaggcaagtttctttgcgcttcatttttttttttttcagagttatgaagatgaaaaaagatcttacagggttcagtaaaaaataacttccagtttcctgtttaacatatgtgctcatggtatacccgacaaaacactgcactttggattagaaaacctgggtgttagtttgtcatatatactagctacatggaattcagcaagttatttatctccttgaacctatcttttctctgtaagtaggaatgattttacttactgtaaggatcacagagatgggataatgcacgtaaaactaatttgtaagttataaaaatgacagtgacaatgggatgctaagcaggtaccattaaataccaccacatatctgagtttctctgatttaatctgcacaaaatacctagatcatctgttttaggctagactctgaactctttaccaccacattaaactgtttttttctctattcaatttaccagtaaaggttgagcatccctaatccaaaaatctgaaatctgaaatgctgtaaaacctgaagtttttgagtgttgacatgacgctcaaaggaaatgctcattaggtgttttggatttgagttgctgaaccagtaagtatagatagtgcaaatattacaaatttaaaaatccaaaatccaaaacacttctggtcccaagcatttctaataaggagtagtcaacttgtacccattgtatgcctatggggtgaccagaccctctccctttccagacagttctgcaataactgattcacttcgcctgtttttggtcatttctgcgtgttctagaggagaaacagaagagtgacacctaggtctcttaaatagacagctgacagacattacgaatctcttcgaagtacagatatgccaaagattgctgtgtagtacaatctagttgtaattgtgagacttttgttgttgttgttgaatacagttaaacaaaaaagctttggagaaactaggttagggaatttgtagtacaaggttgaatgatgttttgaaaacagattatctatttgaaaaatgtttcagaaacctggaagcatttcttctgcatctaatgttgaggtcctggtgaagggtataaaacacacagcatcaactatatataatgctatactagattgtcttgattctgtggtcctggaagagtttatacttgtgttggggaaactatcttggcatagaaggaaagtgaaggttttgagtggggcagggacagttgagcagaaatacaaaggttaaatgtgggcttgttttgattgttaattaataattgagcatgggggaaaggtagagttggaaagtaatttcaggggtggcgatgaaattggtaacttcaaagtggtggagacatgacagtggaagttttatacagtggaacttccccatccctgttttaggtcttcacttagttgcatggttggctctctttgctcctggcccacgggcattattgtaaaactttctaaaacaccctgttatgaatgtcttacccatagcaagatctgacagcgtggacaccaaggcaggcatttcggtaagatttctgtgtattacctcagatacactcagacaactctttaagcaagttattttcttcagggtttatgtttagatttgcgggatattgttttctacactgatgtaaataactgcgagtggtgttgctccagttgtacaagtgtgtattcctctaaggattgatggggaggagtgtagagaacgggaaggaatggatgagttgcttgttaagggaaaagatgatattcttatgctaatccaggccctggataaggagcagagcagccatgcgaacaatggccttggagccaggaagtctgcagtgagtctattccttctcagaaagcttgtcagacccggcgcctggagctgcctggcggggagggacccctggaaaggagagttttctccttgctattttatggaattggctgctggccagcttgttggaaattcccaaacttctctactagaaagtgaaaatcaacggtggggggcttaacaggaagaggaaggaatgactttactctgtagtctgttttttcaactgacttcagccttttcctgtgtttttttttttttaagttccaattgaactgttggttcagttgtcttgctgtttgaggagttttaaaatcttttacttaaaaaagaaattatttatatttgagtaattctgccttaatgttattttcctgaaaagaaacagtaccagtctgtgtatatagcaaggggaagtaaatttatttagatgcccatttcgtctaactattcaatagcttttaaatggcagcatgattaaaaaattttgattatgcagcatgtcaaatatctgcatctccttatattcttcactttgcaagattagatatttttaatgtaaaaattccgatgaatcatttaggaatttaaaaaatatattttatcgttagatattacaattacataattttaagaatgattgtggccaggcacggtggctcacacctgtaatcccagcactttgagaggccgaggtggacagatcgcctgaggtccaggagttcaagaccagcctggccaacatggtgaaaccctgtctatactgaaaatagaaaaattagctggacgtggtggtgcgtacctgtagtcccagctactccgaggctgaagcaggagaattgcttgaacccaggaggtgaaggttgcagtgagcagaggttgcaccactgcagtccagcctgggctacagagcaagactctgtctcaaaaaaaaaaaaaaaaaaggctggacgttgtggctcacacctgtaatctcagcactttgggaggcagaggcgggaggatcacctgaggttgggagttcgagaccagcctgaccaacatggagaaactccatctctactaataatacaaaaattagctgggcgtgatggcgcatgcctgtaatctcagctactcgggatgctgaggcgggagaatcgcttgaaccctggaggcagaggttgcggtgagctgagatggcgccattgcactgcagcctgggcaacaagagtgaaactctgtctcaaaaaaaaaaaaagaattgttgaaaaataaggttaatattttgctatgtgattgtagaaacagttaatatgagacaaaggagaagtgctcagttattaataattacatctgtttgttgaaatgtttactgagatgtaatattactaactcttttgagttagtaatatccccattttgtggtgaaggaaaccgagacctggatagcttaagtaattccccaaaatcacacagcaaataaatactggagctgatttttaaaaattatttatatttattattttatcagtgaataccacatcagtgtatgtggtgttaacgcctttattaatgcagtttttagacgaatggtgttctggggccctcccctcttttcactctcttggaaggccatctccagagtcatagctgaatattaccgttcttttagcataaccgatttgtatgttcagccccaaatgtgtcctttaagtttcagaaccaaatgcccgttagacattccctttgggtaatctcagatctctaaatttgaacctttgatctcttcactcctgtcaaaatcactcattcccatttcaataactgttcatgccacagatgtgggaatcttctttgacgcctcactttcccttaccctacatttaatccattgctaagtaccactgagttttgttttgttttgttttgagacaaggtctcgctctgttgcccaggctggagtgcagtggcataatcaaagttcactgcagccttgaactcctgggctgaagagatcctcccacctcagcctccctagtgtctgggactacaggtatgcaccaccatgcccagctaatttttttaagttttttgtacagatgaggtcttgcagtgtttcccaggctggtgttaactccagacctcaagtgattctcccacctcagccttccaaagtgctgagattacaggtgtgagccacgtacccagccaaaaattatttttgaagtatagcatgagtccatccactataccactgccaccctattctttttttttttaattcatccatctgcacacggattctgccctaatcttaaccaccattgtcattctcctaaatttccacaatattctgcttactcatctgtttgcttttgctattatcccctccagtccattacgtagaagtcagatgatgcccacttaggcttaaatcccaagtccttcatatgcccttgcctgatctggtctttgtcttctctgcctcttcaccctcatctcccactacactatctcttattctcaacatttcagacattgttctctctttgcttttctctccctcaagatctttgcccacggtgttccctgtgcttagaacttcccgtctttctttgcctgactgactctatttttcagatctcaacttaaaggtcacttctcagcattgcttccctttccgcttcatctagattagaggggggtcactgcccctattccttcaggacctggcacttttcttcctttgcacttatcatgagttatgattgtgtatcatttgtgttttcttgtttggtgtcttgagtatcttaattgttttgtttaaggactctgaacttcatgaaggctgggcctgtttggctctgaacagtgtattcttggtatctaatacagaatcatgcatagcacagacacttaataaacatttagggaataaattaataattcaacggcaagaacactgtttccataggactccagcattggaagggataacgtagattatttagtctagggccaggcggtggtggctcacgcctgtaatcccaacactttgggaggtttaggcgggtggattgcttgagtccaggagttcgagatcagtctgggcaacatggcaaaccccatctcaacagaaaatacaaaattagccaggcttggtgacacgtgcttgtggtcccagctactcaggaggctgaggtgggaggattgcctggagcccaggaggcagtgagctgaggttgtaccactgcacttcagcctgggcaacagagtgagactctgcctccaaaaaaaaaaaaaaaatttagtccagtctccctttctatcatgttggtcatgtctttgacaaagatgctctcaaactttattccttatgtactctgtgagcaaagtccctgggttcttttggttgtatctcaagtggagtggttgctatgtcctttgcattcctgtcattcttctctcaagtgcttaggaggcctggccaggtggaatacagtaagatggttgtcctgtttgattacagcagcatttcccttcattctcagactgcatgcatgtcttaggagttgtcatcaataccaatacgtattgagctcgtagtcagggaagatttgatggctgttctccatacaagttatcacagctttttttgtctataaaaatttcttgcagattgaattgttatggatagcacctgttagtgacttcctttgccaggttggcaagtgtgttgtaaacatggatgagaggaggaaacttctatttagcacctactatgtaccaggctctcctaaatagtttaaaatgtgtatttacattatataatatatataaaatcaggcagggaagtataggatagttgttaacatgtagaatctggaatcagacctccttgattttaattatgactctgccacttaacctgttgtgtgatctttgataagttccttaaagtctacttgcctgtttcttcatctgtaaaattaaaataataatttaacctttaaataagttggttgatggtttgataacttaatatatgcaaagcatttatgactactggcacatagaggttaatatgtgttagctattattttatatgagttccttaagtttaaaaatatttaaatttatttaattttttattttaaaaattattttaaatatgtgtttgctgttatctcatttggttctcaaaataactgtcagttaataaatatcattccagatttgtttgtttgttaagatggggtcttgctgtgttgccaaggctggagtgcagtggctcttaactgttgtgatcacagtgcattgtagcctggaatttctgggctcaagtgatcctgtttgagcccaggattacagctgagattacaggcggtcaccaccacagttggcctcattccagttttaaagatgaggaaactaattcagagaggttaagttaaaggcagatccagaatttgaacttatgccagggtagcagggtcgtggatgtttttgcggaaggaactcacacacagtcctttcctctgaaagggaaagcacttagagtctcacggccagccagctctgcagggtgccttggttgtggctctaatgagacaaggccacatattagctttaaataaaccaatgaggaaacagtgacaatgaaagatgtaacaaggcatagcggtcagtctcctgcccaagactgtgagttccttgcagcaggaacaaccatactcatatttgtatttctggtacctaacactgggtcggtaatacgtactccagatgcaggccagttgcagtggttcacacctgtaatctcagcactctgggaggaggccaaggccacaggattgcttgaggccaggagtttgagaccagcccaggcaacatagcgagacccaccgcccccacccctattaaattaaaaaaaaaaaaaaagatgttgttggtgaataagtgagtaaattaataagtgaaaatttggggaggggtggagacctagcaagggaggcaggaccaaagccagggtttctggcatggtatccactggagagtggtagccagtggaggagcaagaaagaaaggtgtgggtttgatttagacaggtggagtgtgattctagtagaaatatttagtgggaaaattgaaatgaggaagagagattaggattggaaatacactggaaacttctcttgaattggaaacctggaacatatatccttagaatgacagttgaattatttcaagaagttttcaaagaaatgctgttaaatcatgtggcagacattattctatagttattttagactttacatctttttctctcagcattatgtaatgggaaacaattttatattacagaaataagagattgcagggatttttagaactaagctacatataacatacacgtgtaaatgatacctcactgtaaaccttctttgcctcagtactgtgaataactttggaaagctaattaaagtgaaaattcttacttagatattataaagtagaaagctcaggttattaatgtagaaatcacaccagggtcattgtgtcataaataagcaagatctttgtcattcaggaatagttcaagctgaaagtcaataaaatcaaaccacatgaaacaatgggatgggggtaaagtagaatgatatatatcttgatactaattagccttttcccccgttatttatttaacaattttactttgaggcatttaaaagttcactgtctatattaataatcaccaaaccttaattggagagattatgtttcatgtcatccatattagaagttcagtttcatcttaataaagtcaaatttgcaatattttaggaaataatttctttaagatactgcttttttccctccgctcccctcccctcctctcctctttttttatgagattgtgtctcactctgtcacccaggctggagtgcagtggcgcagtctcagcttactgcaagcttcgcttactgggttcaagccattctcctgcctcagcctcctgagtagttgggactacaggcgcctgccaccacacctggctaattttttttgtatttttagtagagacggggtttcactatgttagcctggatggtctcgatctcctgacctcatgatctgcccacctcagcctctcaaagtgctgggattacaggcgtgagtcactgcacccgaccttcttttttttttttttttttttttttttgagatggagtctcgctctgtcgtgtaggctggagtgcagtggcacaatctgcaatcttggctcactgcaacctctgcctcctgggttcaagtgattctcctgcctcagcctcctgagtagctgggattacaggcacccaccaccatgcctggctaatttttgtatttttagtagagatggggtttcaccatgctggccaggctggtcttgaactcctgacttcacttcaggtgatctgcccaccttggcctcccaaagtgctgggattacaggtgtgagccactgcacctggctcctttttcttttttttcctttaatgatgaagcaccctctttaattaaatatgtgtaattttcgcctggcatggtgactcacacctgtaatcctagcactttgggaggctgaggctggcggatcacctgaggtcaggagtttgagactagcccggccaagatggtgaaaccccatctctactaaaaatacaaaaattagccgagtgtggtggtgcacacctgtaatcccagctactcagaaggctgaggcaggagaatcacttgaacccaggaggtggaggttgcagtgagtcgagatggtgccattgcactccagcctgggcgaccgagcaaaactctgtctcaaataaaataaaataaaatgaattaatatgtgtaattttctaggtcggcttcctcttctatctatagaataaattatttattagaaagacttagggtgttttcattatatctactagaatttgcaagaatgttgatggttacccttatgttttaaatttaacttttcctgtttaagtcttaatatagttgggaattttcatgttattaataaaataattagaacagccagaaaggactattgagattgtttaatatacttcccttgttgtacatatggctaatctgaggtcaggagaggttgcagcctattaactaaattatttgaagtttgaaattatagtgcctaaaaaaaaaaaagcaaggatacctttaatcttttaaaatgtatttcattgtttaaaggtgtgtttgggcatttgtttcccttttagtttttgaaaaatttccaaaattcagttgtattccttaccttttaaatatttttgtctttcaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggtaaatcagtgttcattttagtaatgtatgtgtgtatataaaaagcactatttcttgcttctgttctttcaactcatccctgtttgaatagttaggcccagcctactagggcagcttttaggaaagaagcaaagatgaaacacgtgccaaataattttttaacttggctgtgatggaaacattttcaagtatttttgaaatctcagtctgagtctgtcttctccttcacaacataggcgtaatgatacacagcattaggtcttgtgaggattaaatgagataaagtatgtaaagccacctcagttagtagctgaaagacagggtaataggtagtccaggctgagcttcaaaattcctctctcctttaaaatacaataaggagcaagtgtaaataataattgaaaaatcattttattggccaggcacagtggctcacacctgtaatcccagcgctttgggaggccgaggtgggcggatcatgaggtcaggagttcaagaccagcctgggcaacatggcaaaacctcatctttaccaaaaaatacaaaaattagccgggggcctgtaatcccagctactcgggaggctgaggcaggagaatcacttgaaccccgggaggtggaagctgcagtgagctgagatcgcaccaatgcactctagcctgggcgacagagcaagactcttgtccctgccccaaccaaaaaatttcattttattgttgttaaaagactttagaaagataactgacacttgtctgtgctgaatactaaaatttcttcatagagcactgacagtttgtttatgaccaataaagtaattttgctactatgtgttcacagcttagaactcccaaacaggaagttattgtgatgactcttaggaccagatggcctgtatttgcacataagctttttcctgtatggtttaagtaggataatattttaagctgaaaagacagtactgttttgcaagaggattttagataaaacttactggatgtcttcgttctcaagttttttacttcacaggttgctttttcctaatgttttgatcacagtgatctggattaatatctgctgttaagaagaaacatgattaacaccataaagcttttgatattttcatcttttttttttttttttgagacagagtctcgctctgtcaccgaggctggagtacagtggcgccatctcggctcactgcaagctccgcctcccgggttcacgccattctcttgcctcagcctcccgagtagctgggattacaggcgcccaccatcacgcccagctaattttttgtatttttagtagagacggggtttcaccgtgttagccaggatggtctcgatctcctgacctcgtgatccacccacttcggcctcccaaagtgctggcattacaggcgtgagccactgtgcctggctgatattttcatcttaaagcacaaacatagaatgaaatctatagcttctttttattttgccttagtattataacaatatccttagtattacaacaatatccttagtattaccatgctaagaatacagagccttcagcaaaagccacttttacttgtgaaacaccaaattatttagtacaatacctttacttcaatatctgttacatgccttgttgatcagcatcaaccaaagctgctatagttttgaagatgagttaaattcatagtaatattatatttgctacctcacttccaggtaatctccattttggcataaatttttttaaaatctgtttagatcacacgtaggcaatatgatacaaaattctcagtcttcgccccagttcacattgttctataataaacttttattaggtggaataagttggtaattagttactacgtaaaagcaaaagatcttattaagaattacatttctctgataaagagtgaaatttgttacatttcctttcaaaaaattattttgatagttgcttcaaataacacacaaatgtttgctcttaaagctaaaaccaatgtagaaaagttatttctgagagatcattaggaaggattgtagaatggtattaatggaaataacttctgactttagctctagctttatcttgttttgaattatgtctcaggaaaataaacttatctgtaccttggtttccttgatgtaaaatagaaataataatgcttatcctagatataaacaagaatgttttgaccatcaactgttagggtatagatttaagtgctttacattgagataaagttacttaggtttgaacagaaaaatgagtcatctgatattaacagctgatagatacttagttcttattttttaagacttggtcacaaattttacaacaggatatattaatgttggatagatatgtagtcccttttttggattttgtcacaaatttcagaaatggattttagttttaagtaactaataatgacttcaatagagatttatttttaacataggtggtagatgtttgctgtacattcagttattgagtagtgtcaaggctgacatgtctgtaattttcttgacatttcccttgtggttcccaagtggttactattatctgcatttgaggcaggtaaaacggggaaagggtcagcactggcctcaactagacctgataccaggaaagcaaaagtgtcacagattttgtcttaagtcttaatcattcctaatagcaagagctactggaaaacagagaaacaggattgtcacaattgtcttaatctatatccattgcctagggctgggtgtgttgttcccccaaacaaaatcagagtttggttagctgggaaaagggggaaaataggtatcaattggacaattaaaaggatctgggagagatttaattttttccatcaattagaatgttttcctctacaaataattaaaaaaaaattaaaagagcttaaacatgacattttgggctaggtgatttttatttttttaaaaaaaagtttgaacaataaagagcatgtagtaacacacaggaagtctgtatataaggggactgtagttggttatgtggctcatcaagacccaagttctttgtcttttcaactgtgacatctctaaatgtcaggttagccacagtgtcacagtgtggctgctgagagactagacatcacatgcagatgaggtaagcttgagttgacaatgctcagttaaagaagagggaaatctgtttgtgtctctttttaattgataaatctttccccattcactcacttcctctccccaacagacttccttctaatcttagtggccaaaattcattatatgctcttgtgttaaatcactggcaaggggaatggaactaaaattgttggattagaccaacgattatctctgctgagagtagagggctgcgcttccctgaatcacgtggaggaggggcagacccttaatgtgtgtgtacatgtgcacatgcctgttgccagcaagggaaggaggagaagaataagagtatctgttgctgggtaccacatttgttgacctgacatcatacatatgctaaaatgctcatgttgctatgaaattttcagttccttttcaaagggttctataccccagagttgcatccatttagtacatgcagctactaatccaggacttctggctggtgggaagccctctccttcgggtccaggtgcctcttcatggtccagcagtgtgtggctaaaagcaattatcagtgcacagtatatccagtatccagtgataaagatgaagtgggataagtactatataaaacttccattcagaggaagaaaaattggaaacaacctcagtattcactgctccatagcatgtagattaatgatgcttaacctgtttgtcagcctccagttttattttctgggaggatttgccttgtctctggtgttccttggctagtgtttctgtcttcatggtcacatctgagctggaattagtggaggatgatctttgtggagactgaacagctttagcggcctgctttctgttagtatggaggtctgattactggaaattgtcctatggattgaaaactcacagcctgactgagtcagcctgggatatctttggaagtacagttcctgtaaagttgtagtggtcctacattctgtttgctctgatctctttggtttcactccattaaacacagttaaatatcttgtcttgatgtgtgttctgagaatttctgacctagccactggcctctgctttgcctgttctcctggcctttggtttagtgacctccgctctgaggcactctgctcctttcccatgctagaaaatgacctgctttatttggtattgtagcacttacctatgaataaatattaaaatagtaccaaatgtcagtatttattcatctttattgtctttctccgtcgaagactgtaagctttaatagatatgggactgtgttttgtttactcttctagtcacccagggcttaaaacagtggctaccaccgtgtactcactcagtacattttggtttaatggatgaatacagttaaagtgaaaaaagcaagttgcaaagctgctttcttagccatatatttttacactgaccaacccagtaacaacaagcacctgtaacaacccagttgtagtatctgattgtcttttttcactaaggatctagaactccttggagaaatcactgagttcaagttcggcagggaaagagcaaggtgatcttggtattttggccagaaagcaaggaaaagttcaaaggattcagtgaccagtttgaattgaatactaattgtagtggattcaaacaaatcaaatatgtttaaatccacgtgtttgtaataacacttaagaaaaaaactagttagggctgagggctgtgacttacacctgtacatgccaacacttgggaggccaaggcaggaggatcacttgagcctcaagagtttgagaacatccacggctaaactgagagtccctttaaaaaaaaaatagtttgagaccagcctgggcaacatagagctggtctctacaaaaaaaaaattttaattagctgagtgtggtgatgtgtgcctgtattcctggctgaggtgggcgggagaatcacttgagcccgggagcttgaggctgcagtgaaccaatgatgacgccactgcactctagtctgggcagcagagcaagactctgtctcaaaaaaagaaaacaaaactagttggttactgttaaaagatgctaatgaagtcattaattttgaaaactggtaaatagagggagaaatcaaacattaatcttgcctttctaacatgaactgtgccacctgtatccaattagtaggtgagggaaagcatctcatagatgtattccaagtcataaaaaagagaaatgataggattagatacattattttatactatgccgattgaattagtgaatctagaccttaaaaacagagataagcaggcatttggttccctcctgcccacaacatacagagcagctgcatttcagcgctcaatagacacatgtgacttgtggctaccatattggacagcacagctctcgagctaattaccatttacaaaatccatagagaacaagaggacatgttaaatgatgccaggaggatgtgatcagaaattccagactgtggtaaatactatactagtaaataccggacaagttacccaatgtctacaagtaaatctcaaggacaggaagaggcagaagaaactggtagattaagagacttggagacaaccagcttatttggatcctgattcaaggaaactactaaagtaatttgtaatatttatgatacaattggaaattagaaagcaatttataacatttataatataattggaaatttgaacattgccttgatgtttgatgatattggtaaggataaggaattactattaatttttttaggtgtgataactgtgttttttttttaagttcttttagagatacacattgaaatatttacagataaatggacatatctggtattagcttcataattatatgaaagggggagggagtgaaacaagaagggccatgaattcatcattataaaagctgggctgtatgggtatgtgtgggttcattgtacagttttctctacttttataaaaggtttctggccaggtgcagtggctcaggagttcgagaccagcctggccaacatggtgaaaccctgtctctactaaaaatacgaaaattagccgggcatggtggcatgtgcctgtagtcacagctactcgggaggctgaggtgggaggatcgcttgaaccagggaggtggaggttgcagtgagccgagattgggccactgaactccagcctgggcaacagagtgagaccctgtctcaaaaaaataaaaagttttctggaagaatacttcatttcaaacatatatatgtaaatgaatagaaaaaggacaagaagcatatacatcaaacggataatggtggttatgtttaaggagtgggaaggggattagatgggcccaaagaggactttttggtttacttgtggggctcaatttttttttggatgctatgagaatatattgttgttttatttgagtattttaaaaactacttttaggaaaaaaaaaaaaaaagacccaacacggtggctcatgtcatgtctataatcccagcacattgggaggctgagacgggcggatcacctgaggtcaggagttcgagaccagcctggccaacatggagaaaccccgtctctactaaaaatacaaaaaattagccaggtgtggtggcacatgcctgtaatcccagctactcgggaggctgaggcaggagaatcgcttgaacctgggaggcggaggttgccgtgagctgtcatgccactgtactccagcctgggcaacaggagcgaaaacgccatctcaaaaaacaaacaaaaaaaccatcaaaaactacttataggaaaaatacttatttcaagcatatgtctaagtagagagaataatataatgaaactccatgaacttgtcactcagttttgacagtatcaactgatgaccaaggctgtttcctctctacccccatgcacttctccctcacccacgtcacccttggattatcgtgggtaattttgaaataatatttcagttaagtataagacaccttggctgggcacgttagctcatgcctgtaatcacagcattttgggaggctgaggcaggcagatcacttgaggtcaggagttcaagaccagcctgccagcactttgggaggccgaggtgggcggatcatgaggtcaggagatagagaccatcctggctaacacggtgaaaccccgtctctactacaaatacaaaaaattagccgggcgtggtggcgggcgcctgtagtcccagctactcaggaggctgaggcaggagaatggtgtgaacccgggaggcggagcttgtagtgagccgagatcacgccactgcactctagcctgggcgacagagcgagactccgtctcaaaaaaaaaaaaaaaaaaaaagaccagcctggccaacatggtgaaacaccgtctctactaaaaatacaaaaattagccgggcgtggtggcaggcgcctgtatcccagctacttgggaggctgaggcaggataactgcttcaacccaggaggcagaggttgcagcgagtggagatcgtgccattgtactccagcctgggcaacagagtgagactccatttcaaaacaaaaaaaacaaaaagcaaaattcctcaaaggccacatactgtgatcataatgcaataaaaggagttcaacagtgtaaactttgtttgagcgtatgacttttttttttttttttctatttgagacgagtcttgctctgtggcccaggctggagtgcagtggcacaatctcagctcactgcaacctccatctcctgggttcaagcgattctcctgcctcagcctgctgagtagctgggataacaggtagacaccaccacactcggctaatttttgtatttttagtagggtttcgccatgttggccaggctggtttgaactcctgagctcaggtgatccacccacctcggcctcccaaggtgctggggttacaggcctgaaccaccattccctgccagcctgctgggttcttaagcgatccttccgcctcagccacccaagtacctggaactacaggtgtgctccaccacacgcagctaattttttaaattttttgtagagaccaggtctcagcatgtttcccaggctggtcttgaactcctgagctcaagcatcctaccttcctggacctccgtaagtgctaggattacaggcatgagccaccatgcctggcaaacacatgatttttttttttttttttttttttttttttttttttttgagatggagtctcactctgttgaccaggctggagtgcattggtgtgatcttgtctcactacatcctccacctccctggttcaagtgattcctttgtctcagcctcctgagtagctggattacaggctcacagcaccatgcccagctaatttgttgtatttttagtagagacaagagtttcaccatgttggccagactggtctcaaactcctgacctcaggcagtccacccgcctcggcctcccaaggtgctgggactacaggcgtgagccaccgcgcctggccaagcatatgatttttaatgcaataactatattcatgtttctagaagcttttttttgccattcagtgacattatggatgacactgcatgtcagtatgtgtcggacatgtgtcagcatgtgtcggaatgtatcaacccatttttgataatgggttcagaaccaagtttgattaatgttaactgatttatgcagtttttatgttcaactgaaatacatctaactataattttttattggccttccaaaagtgtcataaaataagcctaatcattcacatatcctatcagatgtgaaaagcccatttctatgctttctggccctgccgcaaaatcttttcttttcttctccctttgattttcctcctagaccaacgtagtatgacagaactttgtttggtgatggaaatttctatatcagtaatttgcaaactatagcccacaaactaaatccagcgcattgctgcattttgtgctgctcatgagtgaagaatggtgtttttgcatttttaagtgattgaagaaaaatcaagggaatatttaatgacacatgaaaattatatggaattcaaattttattatccataagtaattttattggaacacactcatgttcatttttttacatgttgtctggctgattttgcattgtgtcggcagaattgaatagttgtgacagagaccttggggcccacaaaaccaatacctgttttctatatctctgctgtcttgtgtgatagctactagccaaatgtggcttttgagcacttgagttgtgactagtgtgggtgagaaactgatttttaattttacttcattttaattcgtctacattttaagtcacatgtggctagtggctaccatatgggacagcacagttgtagacatgccaccttttccctagttcttgcttccttgtacttgactttccttctgctgatgtcttcctggtttctatttaattaatgatgcagactgttgttgcagaattcattaggctaccattgctgattatctcatatgtatagtgcatcagtagcccattggtctcaccaaccgtttgccatctgagttctgttgtagacattctatcttaaggttgcggcagagggcatttatttgctgtagaaaaaggaagccaataaattattgggaaaatatgaaaaattacttagccaggaataaaaatctagtaaaatcattgatgccaaaaattgctgttgatgacaaggacctgtaaatgtgcctgtgtatggtcatgtgtctcttgtaactgtttgtctctttgtatgtatatgttttcattttttcctgagatgttatacttaaacatgtaagctattaaatattttgtgtgtgtttgttttgaaatataacctatacccccagtccaccccagggctcgtagtttattctttgtaaatacacgggacttgtgggtggcgagagattgacatgttcagaactgacagaaggccatgtgccaagtaaagtgatgatggtgaggcctgcaggacccagatcctgttgggccctgggagcacacagtggaggttggattttattctgagtgcattgtggagccattgattggttttatataggagtgacagatttgtgtttataaaatgtctctggctgctctgtggaaaatggattgcagggaccaagagcagaagcagagggaacagttggagacttcttaccttagtagaggcatgatgtgatgggccttggtgacaacagcggagttggagaaaaatgaaaacaattgacatacattttggaggttgagccaaaagactttggtaagaccaggtttgaggcaaatcaagagttcatttaagacaagtcagtcaggagatgtctaagcaggtcatggctagagggggtacatccaggaaccatcaacagagtgggcgctgtcccctagggagagcacagagaggctctttcctgttacttttctttgtattcaatatctgcttggtgaaatcttgcaagtttttaagatgtagcttagatttcattacttttgacacctaagatcagtttgagtttgacacctaggatgagccttttcctttgtttacatgtaaacacctccgtattttgtcacttttttttttttttttttttgagatggattttcgctcttgtcgcccaggctgaagtgcaatggcttgatctctgttcactgcaacctccacctcccaggtcaagtgattgtcctgcctcagccacctgaatactgggattacaggcgccttgccaccacgcccagctaattttttaatatttttagtagagacggggtttcaccatgttgaccaggctggtcttgaactcctgacctcaggtgatgtgcccactttggcctcccaaagtgctgggattacaggcgtgagccaccgcgcctggcctttgtattttgtcacttttcacattgtatttatttgcttttgtgcttattccccctctgctttccaccaagtttctcaaggccacatatgtggttttgatgccacatctttgcgtttctagcatttaataccttgcctgcacataatagacccctactaagtattctgttgaatatttggcaataacataagctccagatacaactactgtaattgagttttttgtctcatgaattcaaatagtattctaggaagtttcatataactttgagttttttcatgtatcagtgatcttttagtgttctgatctttgttattagtaacatcttcatttgtatactattttacatgtagttaagcactttagtaaatattcatttgatctacctataacctcttgatttgaattaggcaggaattattatccccattttctatagatagctgaggttcagagagtaacttatctgtgcccgtaactgcgacttgaacccttcacttcttgctgttatctcaagtgatatttctgccacactaaactgctttttctgtgtcactagatttttgaaaaatcagttgctgtgatatattatatactgtttgttttccagagctgaattgatacgtgtcttctgttaatgtaataggattttaaagctggtcaggttccctcacctgtcctctagtcctgtagccttatagagtaaatgaagcctggaaaggtgacatggcttgcccaagaccatccagctaggtaaagcggggtaggcccatggcaaaacagaatcccagtctcctcatttcctgctcagtggatttcttcccttcctgtacctcctgcttcccccaccccatcttttacagttgatgtttctaacataaaggaggtctttccgctttgtagcaatcagatccaacggaagccttgacattatattacggaatttatttctgaaaggagagtggtgtggggggcgcggggatgagtaatatatgtatgtacacaaacttccagctttttttttttttttttaagtgttttctctcctggccgggcacggtggctcatgcctgtaatcccagcactttgggagactgaggcaagtggatcacttgaggtcaggagtttgagaccagcctggccaacatggtgaaaccctgtctctaccaacaaaatacaaaaaaattagctaggcgttgtgtggggtgcctgtaatcccagctactcgggagtctgaggcaggagaattgcttgaacctgggaggcggaggttgcagtgagtcgagattgcaccagtgcactccagcttgggtgacagagtgagactctatctcaaataaaaatgttctctatactcattcagtagcaaattcttttactaaatattcggtataagaaagtgaaggttattggccaggcatagtggctcacggctatattcccagcacttcgggaggctgaggcgggaggatcgcttgagcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctcaaaaaaaaaaaaaaaaaaagtgaaaattattgaaactgaaggcatgtaatcatcaaaacactatttagcagcactttttctgttacctgtgtgtgcatatgtgatattttttgtcttttcagtagtttatctcatcagtatggtaaatgtaaaatcaagtctgtgttgtgtcttgaaccacttatttaacattcataatgaaatacatatacacttgtctgtttggttccacctttcattcccttgagagtaacccacaaagaatggcctagctgagtcagagagaggaagtaattactagaacagtttttttagttccgttctgcttccagcctgaaagatttagtaccaaatatgacagtatctgtcactgcaggctgctagactctagtgtaagaacatagttctatttctgtgagctaactgctgcccttctataaccttcagtttctgccagcatcgtctgcattcaaaccaatgacctcgaggtgaaaatctccagataacatgattggtccccatgctctcatgatttccttacttaagcaattaaaggccaaagcaagatgcttagtaactccttttccacatagaggcacaaataaaggaaagctggtcacaagttttgaaccaaagagttaaaagaagaatcataacttgtctctatttaatgattggaaactctcacagacttctgtgaagtctctcccccttttgtacctttcttacaagtgatgactatatacttttacctggcaggggagagaccacggtcacgaaggtggttttcccagggcgaggcttattcattgcactccagatgtgctgacccctgcgatttccccaaatgtgggaaactcaactgcataattgtggtggtgggggactgcgttcatgcttttccctggttaaattaaaaaatttttaagttattttaaaaatataaaaaacaagatttgactgtattctgccttgcgccactcttgtttgtctttcactagtgcaaaaattgtgatatagctgtcttcatgtaccccgcaatacctggtgcagtaattctgtgcataataatgtatgtctgtttgttgtatgaatgaaatttatatttctaaagaaacatgctagctacaattattgtgataagaaagcttaacaactttttctcattgaaaattgtcacgaaacaatgagcttttcagaaatgatttacttacaaattccatatttgaatgcaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcatgtaagtattttatgcagcccttcttaagagttaggagaatagagttgcatttagtgctattttaagaattattaaacttgtctgcggtttttttttcattcatatatagtatctttccagaaagccaaaaagccttttgttttgtatattagaacattattccattaaatgattgataggtgagttactatattagaattatgttataatgcagcttttaaaataagatcaaagggatctagtatttaacatctgagtttttaatgatcttttaatcttaaatttattgatgctcattttagaaaacttagaggttaccaaaaaagaaatcagaaaactcactgacaacctcctacttctttttaatttaaaaaaaaattttttttttaactatagacaggatcttgctatgttgcccaggctggtctcaaactcctgggctcaagcagtccttccacctcagcctcccaaagtgctgggattactagggtgagctgccacacctggcctcctacttcttaattagttgaaatattttgcagatatatataaatcatattgtgttaattaattttatgcttttttcttacctgtgaatttaccaatccaaatctgatttataaaatgattttaatttttctagtgtatttcgtgttagctgcacaacatgtttatatatgatcatgtaattctagtccatatttgttggaaacattgacatattgacttaataagaccaaaaaaaattgcctgaacaactcaacctcatcagtcaattaattgtctccttgttatagaggcaataatgaatgtcatgttttatacttttaataattgtatgttccctgaatggaccagatagaaagcatgaaactttacacgtaaactcttgaacctgcatgacggtcatcgtgtcttaggtttgctgcttgtcccctggtggtggtgggctctgcgtggctgactgtgactagttgttcatttttaccttggtgagagtttgccagcagggaactgctctctgctatgtcaccaaataatgttttgctaaacttcttgtctgtagtacctgcctgatgtaatgggctgtctgttagtagcttagtaacccagagtaaaactgaatcatccattttaacagaattctgccccacacttaacattttctcctaacagaaaaccaagaattctgcaaaattcttctaagtagaagcagcacaattcctgatattaacaataaataggagtacagaaaaagcttttagaaatttctcccatacctgttaaagtctatatgaatatattaaggggaaactccaggatgctaacactaaaataagaatttcattatatatgtatgtaaatttattgaaaatttattcaaaagtcctctccctgttttcccatcatattcagtaaaaggtgccttttagtccccttttttttggtcattaagcctatttgtatgtttcagagaaaagtttgtttttatctattatcatatacaatatggaagtactgaaaaaatgggtaaaaagagacaaagttattttaaagtatgttttcaaaacatgacataaaattttataaatcagctttctgtgatcacatgactgattagcaaagagaagtcacataactcctatgtggaggacttgtttaattgaaatccttttcttcttgacaaagggttgtcactggccttttagatcttggctcagacataactttcatttgtcttaaaacctctggcgttgccaataaatcacgtgtgaatgcaattctaagtcacaaaacaaagtattaaaggccatctgtacctgttcacattcagactcaaatttcgttagtactttctatgtgaatttatgttttgttttgttttgtttttttctgttttagaactaatggacattgctttgccatcatagaagaagatgaccagggagaaaccacattagcttcagggtgtatgaaatatgaaggatctgattttcagtgcaaagtaagatataatttgggacccatgagacaaagaagggaggggccatatgaaagcatcgatttcccccaggagaaacatgcctggtgtacacatcgctgtatgttcacatcagtaaatatattggaggaatacctactgtctagattctgtcctgtattcatatgtagaatttataactaaatcatttctgaaaagctaattgtttgattacaatttccttttttatttccatagacagcacctggctctgttgcccaggctggagtgcagtgctgcgatctccgctcactgcaacctcaagccagcctcctgcctcagccttctgaatagctgagactacaggtgcatgccactatacctggctaatttttgtattttttgtagagacaaggttttaccatgttgcccaggctggtctcaaactcctgggctcaagcagtctgcccgcatcggcccgcaaagtgctgggattacaggtgtgagccactgtgcccagcctgattacagttttctttgttctctacttgggaggctgaggcagaagaattgcttgagccggggaggccaaggttgcagttagccgagatcgttccacggtactgcagcctgggccacagagcaagaccctgtctcaaaaaaaaaaaaaaaaaaattcttttttctttttttaaattttaaccgtctttggctactgattacaattttcaatgagaaaaagtttctaaactttcttatcacaataattgcagctaacgtttctttaaaaataaaaattttattcaagtaatatgattatggtaatttaagttccaggttattttaccttaaaaaaagttttaaatcatcctaggttgtcatgactgcaaaaaaattatattgtcacacttatttgtagattataaaatttactgagaagacttttaagatagtggcagtaacctttgtatcactctgagacaacttagaaatgttaaagatatactgcaaactctagggtaaccactaaagttgaaaaaaaaatgttaaggccttgtaaggaggtgtcagtggagctctttaaaagcagcagcaaaggaatcaggatggtaatagtttatgagcatcctgatggctctgggttataaacctgatctcttcaaaattctgcatagtgattttgtcccaggagatccttccagtgtttctgaaaaccagctccagatagaattgtttgtgcataatttaagtctcagctatgttagaaaattgttcctattatttggaaattctcaggatggaggccgggcgcggtggctcacgcctgtaatcccagcactttgggaagccgaggcgggtggatcacgaggtctggagatcaagaccatccggctaacatggtgaaactccgtctctactaaaaatacaaaaaattagctggacgtggtggcgggtgcctgtcgtcccagctactcgggaggctgaggcaggagaatggcatgaacccgggaggtggagcttgcagtgagctgagatcgcaccactgcactccagcctgggcaacagagcgagactctgtctcaaaaaaaaaaaagaaaagaaattctcaggatggatagaaaccttaaaggttatgtttcaacctctcagctaatgtttggaatcacccttgttgcaaatgactgcaaatctatcttcctttctgactctttggaccatagagaacaaacctaatctctctttaagatgacagccctttactaagtaaaaaaagtgcttcatcctactagtctttgcccagtgaaaataattgtccataatgacctcaactgctccttatatgatcagctttagagttattcagtctccacttcctcagtgtaatatgcagaattgagtgtgatatgaccaaggaaaaaagtagagaataaatagccctgttccctttttctaaacatagtcttgtgttagatatttggcagtcatgccatattcttgaaccattgagccttctgtccgctgaagtccctatgctactcactcatgctgctgctaagccacatctcctccactcttcattggtgctgttggtttcttcacacaaataagtagatgggaatggaatgaggttttcctatacagttgttacatacttgtctttatgaattttatcgtataagcattaatcctttgctctaatttgttgggatttaaaggatgctaatttcgttgttccagttttaggctatttgcgtatttatcaagcacacatactatacattttttaatcacttaaaaaattgaagaaagagctatggttagggtactgagcccagcagtaataaccagtgttcaacaggcccctagtgtaggcctgtcctaagctgaattcaccattataagttagttgttaaacttgacaagctgttcaaatctatatactatatatgtgaaccttcggacaaggtgctctgctctcgttttctcatccatgaaggaattactatgaggatcaaatgagatacatgtaaatagtttagcacaattagcacatagtaagggcttaatagatgttagctttgaccatattgattctttaatagagcagtcttcatgctgttacccatatccctgggtacactcagactgtgttatacaagggtaacgggcacgttgatagttttaagggaatcagtttttggatcctaaacttcagtaggtcctgttgctgaatatttctctgcctgagaacagaacttctcaagcagttctctttcccttagtcacttttcatagtcaacccctcctagtttacaaatagaaggcctgaggtgtaaaacttcaaggttccaaacggtgttgtaattcgaagtaaaggcatcagtgtaggctatgtcgggatatcaaataagtgtttacatgacagatggttttcaattgtttgctttcaaccaagttgctggatcattgaaaataattttcgatgataggatctttatggcacttttagcatatgctttggaaggactttaaacaattatgggctgatcgtggtggcacggtggccccagcctgtaatcccagcactttgggaggccgaggcgagcagatcatctgaggtcaggacttagagaccagcctgatcaacatggcgacaccccgtctctactgataatacaaaacttagtcaggcgtggtggtgcgtgcctttaatcccagctacttgggaggctgagacaggagaattgcttgaacacaggaggtggaggttgcagtgagccaaaatcatgccattgcactccagcctaggcagcaagagtgaaactccatccaaaaaaaaaaaaattatgggacaatggtataatagtctccttccgtgatcatcatcttgcttatgtgaatacattgtcttgatgatgacaaaaggaaaaataagaataagattaatgatgaatcttctcactctagcagtaatttttattcatgaattcgtgaactgatttgtttcaaaagtcccatccatatcattaagaaatgcctggccaggtgcagtggctcatgcctgtaatcccagcacttttggaggccgaggcgggcagatcgcttgagctcacaagtttgagaccagcctgggcaacacggcagaaccccatctctacaaaaattagctgggcctggtggctcacgcctgtaattctagcactttgggaggccaaggcaggtggatcacctgaggtcaggagtttcagactagcctggccaacatggtgaaaccccgtctctactagaaatacaaaaattagccgggcgtggtggcacactcctgtaatcccagctacttgggaggctgaggcaggagaatcgtttgaacccaggagttggaggttgcagtgagccgagatagcaccactgcactctagcctgggtaacagagcgagactccgtctcaaaaaagaaaagaaaaaaaaaaaaaaaagctgaggtgggaggatgacttgagcctgggaggcagaggttgtagtgagctgagatcatgcaactccactctagtgtgcggagtgatagctagatcttctatcataaaaaaaaagaaaaagaaaaaatgccctttccaataacattttcttaagtttgtatttaatgaagattgtaacatatatattgttttgatcaattttatgctaataatgattatgataaactagaataattttctaagacttaaagacatacagttataggaaataaaagaatttttatgtacttatctttgatgtggacagttatatattactttaggacgtaattatcatgggagatattgaaaggaaataagagttcaaggagaaataagagttctagtgtaaaatttctcattgctaaaagaagcatttgttcatttattctttaaaatgatgataatgggtatcaaattgcaatgctatttagattctactgaatgcattaaaaaatgatgtaacacttctatttcaaaatgaggtaacaattctatgtcaaagtgtcattatgtacagtaagccagaaattattaatatattgcagccatttaaatttatggtgaaaatttttaagtgtcacctgaaaaatacgtgaaggatacgttgcttttaagaattgggttacgccagcaagcattttgaccagcacttatctaactttctgtatttcttggtaaacgtcacccaagcacagcactcacccaagcacagctctgtcatgctcatcctaaccctttccccagtgtcttcacgcactgccatgtgtggcacagaacagatgtgagtgcctctcaccaggcctcgcgttcttccactccccaggctgcattggtaaattgtgcttattctgtttcctcctataggacaaattatttttcagaaacctcactgccattccttgtaacttggcgtcagttccttcctcatatactgtctccagcctgagcacactgaataagtttatttaagtcagaatcacttaattcatcagtgccaagtaaatttgtttcccacaaaaattcatattccccacataagtctagaaatacaaaattgacttgggcagagggtacgggtggagagtgcaggaaaaggaaaggctgtgtcacccaaattcataatctcgacaaacccaatttttgcctacccagatacatagttaacctgagtaagacagacgtgagatgaggcaggtgttgcttattcttagtgaagccacaatgggtctttagggacttagaagttttttggcttagtctagaatctcatctgggattcatgtcaagcaagaggaagggaagttaatttattgaatatttgttatatgtgtatagtatcctggggattcagtatattctaccttgtttccccccaactactctatagagcagatttttttaaagacagggtattgctccatcacccaggctggagtgcagtggtgcaatcacagctcactgcagcctcaacctcctgggttcaagtgatcctcccacctcagcctcctgagtagctgggaccacaggcgtgtaccaccacacctggctgatttaaaaatttttttagagatggggtctcactattttgcccagcctgatctcagactcctccgctcaagccattctgccacttcagcttcccaaagtgctaggattacaggtgtgagccactgttcccagttcatctttttttaacctgtattttttagcacactaaagcctagagataaattacttgctcaagttcacaaagtgaacaactggcaaagctaggattcaaactgtttgattccaaaacccttgtattttctgtaatactatgctccttaatctgttggcagagtctatttttggcttctttttaaaaattattatttttagagatagggtctcactacattgctcaggctggacttgaactcctaggttcaagtgatcctcatgcctcagcctcccaagtagccaccacacccagtttaaagtctactttctttcccttttaaagaaaagggacgtatataacacatatatatataacatatatataaacatatatacatgtttatatgaaatgtttatataaaaatataacattccattatctattgtagtttccaacactccatctttctaaagtctttaaattacacctgtctttcagccatctctcttacaagggctttcatcttcctgggatataattcacctaggttagaatataggaactcataaggaatacaaacgcatcgtaagatctcttcgtacatttgggatgtcgtttcccacttagtagtgtttgagctaccttcgtcatccctgtcagcatccttcatagagaagaaaaaacaagacaggagttgaagaattgttcgtttttctccttatcatccactgtcatgtcagcagtacatctgttgcttggagaaaccccatgctgccaaagaaaccctttcttggtttttctttgcacttttctcttctgcaaggccaagctcattttagctttcctggaaccgtttttggatgcttgacacttctttcattcatcgttagttatatgattttcatttcctcctccatgtgttttctctgaatctgggattatttcagactctccagtttaaccctaacttttttctctctctccttatgatcatttaaaagtaaaaattgtttaaaagttattaataaaacttcatttaaaatataaaatatgtatttggacatttccaaatgctcttgaccatcttcccaacagaatctgaagtcacaggctcatgtttacctttttaaagtcatagctgattatactgaggcttttccttaatttccgcttacattcttgttacttgtgtagtgacaaacagttctttgctattcacatgttggtcagaatggcagttctccccaggctgcagcattcaacttgtcagatattgtgttgttaatccaataaaacatcacatgcaagtgctgctgcgcttccagtgactgtgtccttctctgtgctagctttctgctctcttagggacagtctccttgctggctggtggtctgtaatcagctctcaagaatgctttctgtagtttgtccttccctcaccatggatgctcaacttgcctctgcatcaggctcatgacttccgacgtggctggggtaggcagggtctgcagcgcctctgcacgctcagctgccttgctaaccagccttttctttggactacgacaccctccactttttagtctgatcttaaatctcatccacatctcagtaccacagtgagattatatgtaccagaccagtttatgattgtaattacctaagttcgggtttggtgttctaatctagtgtctaacacaccatccacatagatatgttcttaagaaaagccattttgcagtcttcactatttcagcacaaattttaatctttcaataatctgtttttacatataaaatttgcaggcccctttcactcactgaaatagaaattgtattttatgaatactaaaaagacatatcagtttaaaataccaaaccatttctaattttatcattactcttcttttaggattctccaaaagcccagctacgccggacaatagaatgttgtcggaccaatttatgtaaccagtatttgcaacccacactgccccctgttgtcataggtaggttagccgagaaaagtcggagcatgcttctcaaatatcttctctggttttacagtaaccaggctacctagaattgaacacgtcagattattttttcatttcaattgtttacattgtttacttttattgtcaggtccgttttttgatggcagcattcgatggctggttttgctcatttctatggctgtctgcataattgctatgatcatcttctccagctgcttttgttacaagtaagaagatatttattttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaattgggcacaatttcatacttcttgtatgttcatgattacttatgattttcttattaatggaatagtgagctttctggcatctgaatgttttcgatctgtcccaagaaacccactgtgttataattcttttttttttttttgcgttataattctttagaaatttggagctccagaattgtttgcatgtagccatgatttcagaagacagttgccaaaaaagaagagtaataagagacagtccctaatggatataaactttaataataaaacatcataccaacctagatacattaatgaaacaagttagtaaacccataaataaacaaacccaagtacatacagcaatttagcatataataaaggaaacacttcagattactgaggaaaagacgttcgcatacctccttgtttttattataattcctcaccctcaacaatggggtaccacagttgagaaatcgtgttttgggtctttctagataatagacttggaatcttctgttagggaggtgatgcgaaagtcatatgattattcagagtaggagatggggtcgagaggagagctccacatctgaggtagccatcatcccaaatggcccccagtgattctcactgcctggggttcctccccttggggccagtcccctcccataacacatcagggctgatctgtgtgacaaataggatatggcaaaagtgacttccaagtctacgttataaacagctttgcagctttcaccatggtctctgggatcactcactctgggggaagccaggcatcatgctatgtggacactcaactctgagagaggcccacacagggaggaactgaggcctcttgccaatacccagcctgcagcctgtcggccttggaagtgagccaccttggaagtgactgcaagctcctgtcaagctttcacatgagtgcagtctcagctgacatctgaccctgagctacccaatcaagtcactcctgaatgcatgatccacagaaacagtgagataacaattgctgttttaagccactcagtttgggagtgatttgctaacacagtattggataatccagtgtccgactttctgaaaattgactttcaagcagtcttcttggtgttattgtcaccctcaactttacttccagacataaccacaatggccagttccgaagttcttgggggaactccatagtataaactggttgcttcttggttttctcaatttctaacctaagaatcagactttttgggtgtgcaaagtcactgctcattcatctgcttcatgaattccaacagtgtttactgttattttatctccttttctccttgcctgttagataaagaagtttaaaactctttattgctgttttagtggactagtaaaagcaagcaagtatgctcaatcggttattttaagctcaaagtccctttgtcaaataactgaatctttgccagtaagacaggtgataatatctcaaggtgattttaatttatattttcatattaaaatactttttttatacattggtttctttattacacaagggcactgtaatgtatatattattttatttatttatttatttagaaatagagtctcactctgtctcccaggtggagtgcagtgatctcggctcactgcaatctctgcctcccaggttcaagcgatactcatgcctcagccttgcaagtaactgggattacaggtatgcactgccacacctggctaatttttgtatttttagtaaagacgggggtttcaccatgttgaccaggctggtctcaaactcctgacctcaagtgatccacccacctcgccctcccaaattgctggaattacaggcgtgagccaccgcacctggcctctaatgtgtatagtaaaatattgttgagtatgcttttatttttcttttaagaaaagaaccatctatatttttatttaaatcatgtattcattttggggggcctgtttttccattgaattgcatagatttttttctctttgatttatagaagctctttatatttcagaaatcagccctttgtaatatgagctacctatacttttctttttttgtttttttttcatgctgcgttacctcagagctacctacacttttcactgtggtgtgtcttgagactgcctgcagtgccttcagccacatagtaaagaaccctatcagccaggtgtgtgctctctaagcaatgggtaggatgtttcttaaggaaatctgttcagcccaagagataaaacctaaaaatactgctgttagggcccagtgaaatggtccaggcagattatcttacagtgaagcttgtaatcagtaaaccctacccatatactaacagcttgccaatcaaggtgtcaggctgtgaaggatactgatctctgagaaaccagaaacaagtgaggtgagccttgtgattgcccaccttcttctccctgaacagagtttcgggttgggcatcacagggggaacccaggtgtagccagtagcctgtctcagttcgaagagttgtgaggaagctaccaagcctagggaaagagcacctgaaatgattgagaaaacagtgtttggtgctcacacaaggctgggagtaggatctgttcacaccagctgtgagagttgaaaaccccataattcataggttttggttgaaggactcaggaggattttgcctcagtggtggggaataattagccctagactaaacatggctctggtctcaccctaaaagcaagccccaaacagatcacaccatttctaagtcactgtatcctagaacaaactcaacagtatttataggaatataaaaatatctggcatccaacaaggtaaaattcacaatatctgccatccaataaatgaatactatgaataaatgaatacatatataaatatggtccataatgagggaagaaatgaagcaatcaaaaccactgacccagaactgatatagaccttagaattagcaattacattaaaatagttattataactgtattttttatgtacaaaagttaaatcaagacatggcagattttgtaaaagaccaaaatgaaactttaggaaatgaaatctataatatctcagatgaaataatatactagatgaaattagtgacagactgtagaagaaaagatgagtgaacatgaagacataggaatgaatagagaatagtgagctgtgggacaacttcagatggcctaatatagatataattggagttcccagaagagaggagggacgaaaaacatacagaaataatgatcaaatgttttcaaatttatctattattattatttttatttatttatttatttatttattttgagacagagtctcgctctgtcgcccaggctggagtgcagtggcacgatctccgctcaatgcaagctccacctcccgggtttacgccattctcttgcttcagccttccgagtagctgggactacaggcacctgccaccatgcctaagtttttgtatttttagtagagacggggtttcatcgtgttagccagatggtctcgatctcctgacctcatgatccgcccgccttggcctcccaaagtgctgggattacaggcatgagccaccgtgcccggcctattatttttatttttgagacaaggtcttgctctgtcacccaggctggagtgcagtggtgcaatctcagctctctgcatactccacctgctgggttcaagcgattctcgtgcttcagcttcccaagtagctgggattacaggcgtgtaccaccaagcctggctaatttttgtatttttagtagagatggggtttcaccatgttggccaggctggtctcgaactcctggcctcaagtgatccacctgcctcggcttcccaaagtgttgggactataggcgtgagccactgcactcagctttttcaaatttaatgaaaaccatgaatccagatatctgaaagctcagcaaaccctgagtataagaaacatgaagaaaactacattaaggcacatgataattgtattgctcaaaaccgataataaagaaatgttaaatgaaacaagaaggaaaaaaggcagagtatctacagaggcacaaagttaaggatgacagcagaccttctgttggaaacagtgcagtcaagaagatagcgaaccaacatctttaaagtgcccaaagaaaaacatcacagactttgaattctatagccagagaaaatatccttcaaaaatgaaggtaatgtgaagatttccagtcatacagaaaacttgaaagaaccccgcccccttagacctacccaacaagaaatgtgaagggaagttcttcgggtggaaagacaggccaggtgaagataagaatccacataaaagaatgaagatccggaaatggggatctaagtgaccctggcacaaactaacaatatcttttaagatgaacaaaaaagactactcatctgagactcaggccatggacactcaagtgagtgacctataacacttcacagaacatacaatcagacatcaggaactggtcatgtaggcttttttatagttctaaactaaatactacatagaactttgtgactgccctgtttatttagctttagaacttcatgtgctagttcagtctgtgaagattcattattgatcagatatatacaatctgtaatttggaatattcattcatatttagttgaactttaacaagtcacaagttgttctccatagcaaaccgtaaaagaataaaattaaagttaaagagaggtctgtccgtcagcatattaaggtttgtctgttttgtttgcctcattaatattttgtttcccttttttctgatgtgatcgttttcctccaatttagatacgtctgcaatttattcttcagtctcatttacattcatgacccatgatcctcaaaacctataccttctctaaaaccttatctggaaccatggcctccctccactgtggacgaggcatcattctgtaccatacgccagttcctggttgtttcctctggcatcttcttttgtagctcctttaatccttcagactgcttagatcctatgatctgcccccataacacttactaattttatcttgcatttttttacattggcaagtattcgtttacttactcatgcatatttgccaaaagtctgcatttccattcaacaggaatctcattggtaacagagattacttaaccattaatattgatgatcaactggctggctgtttaaattgccactttcctattgaattttgaagggtgcccatggtgaatcttgtgtgtccctcatgcttggcacacagtggatacttactcactcttgttgatgtttgccagccaccttggcccagaatttctgcttgggaaatagtatcacggatgcatttgtcagatgaaaagcctgcttctggctttataatggaccctttatcctcattgtctttaggggactcctggtcctagagtagttaaatagtaagaattgaatgatttttttaagttgcagtgattacagcaaaaaaaaaaaaattgccaagtaatgttttatttaataagaaagaaacattttctgaatacctaaaaaagaagctgccaatcagcttttaaagtgattaaaaataagaaaaaatgccctatatgtacacatatttttatcactttcagcactctccatgtatttaattccaagttttaggtccaagttttcatttgataccatattccttctgcctgaagaatttctttaacctcttggagtgcaggtctgctggctgtaagtcctctcagcttttgtctgcagtcttttgacttcattttcccaaggtattttcactggctatagaattctggatgggctcaagtttgtttcccttaaagctgtcactcattatcttccacttgcatgccttctgacatacattttatctttgatgtattatatgtaatttttttcatggcatcctttaatgttttccctttatcttttaaacagctacaatacatttagaagcgtgtgtgtgtgtttcttttttggtatttactctgctttgggtttcactgagcttagtgaatctatggtttgctatctttcattattattgcaaaattatctactattttttttaaaacactttgtccttttggctgggcgcggtggctcacgcctgtaatcccagcactttgggaggccgaggcgggcggatcacgaggccaggagatcgagaccatactggctaacatggtgaaactccgtctctaccaaaaatacaaaaaaagaaattagccaggcgtggtggcgggcgcctgtagtcccagctactcgggaggctgaggcaggaggatggcgtgaatccgggaggcggagcttgcagtgagccgacatcgcgccactgcactccagcctgggcgacagagtgagactccgtctcaaaaaaaaaaaaaaaaaaaaaaaaaaaaaaaaaaaaaaacactttgtccttttatctgtctcttctgtttttgagactccaattatacatattttagattatttggtgttgtgccacagctctttaattcttcagtttttctcacttgttttttctctttgtattttagttcaggtaacttctatttacctattttcaaatgcacagatttttttttttcttcacctgtgtccatctgagctgtgtattgttgagctcatcaaacattcttcatctttaatagcatgttttccctttctcacattcctgtctgacttcatttttctgctgagactctccatctgtgtattctgttaccaccttcaccagttgccttccccttttaatcacagttctgtgaaaggccctcctgacagcttcagcacaagtgctgtctgacacttggcctcttgattgcctgccctcttggcagtgagtgattattccttgctttttaatgggtctcataagtttatttggatgttgtacatcatgttaagaatagcagagattgtcacaatgagatatcaacctcaccccaattaaaatggccattatcaaaaagaaaacaaatgctggggagggtatggagaaaggggaaccctagcacactgctggtggaaatgtaaattggcacagctactatggagaacagtgtggaggtccctcaaaaaactaaaatcagaactaccatatgatcttgcaatcccactatttggtatatatccaaaaggaaatcagtatattgaaggcctgttcattcccctgtgtttaagcactattcataatggccaagatgtggaatcaaccgtgtccatcagcaggtgaatggataaagaaaatgtggtccatacagtggaatattactcaaccagaaaattaatgaaatcctgttattttcagcaacgtgaatggaactggagttcattaatgttaagtgaaataagccagtcatagacaaatattacatgttctcaatcatacgtgggagctaaaaaggttgatttcatagaggtggtaagtagaataacataccagaggttagaaaggagggagggaggttggatgaagatggatggatgaagagaggttgattaaggggcacaaaaatacaattactaatagaaggaataagttctagtatttgatagtacagtagggaaattatagttagtaatttattgtgtatttcaaagtagctagtctttaagagaagaattgtaatattcccaacacaaagatacagcctgggcaacatggtgaaaccacatctctacaaaaaaatacaaaaattagctgggcatggtggtgcacatctgtggtcccagctgctggggaggctgaggtgggaggattgcttgagcccaggaggcggaggttgcagtgagccaagatcatgccactgcactctagcccaagcgacagaacaaggccctgcctcttcttccccacccaaagaaaaacaaaagataaatatttgaggtgatggctatcccagttactctgatttgttcattttacatcgtatacatgcataagatatcacatgtaccccccaaaatatgtacaactattatacatcagttttaaaaagaacaacagacattgaaataaagacatactcctgaaaatgggcatacctcctcttaggctgttgataggcaggaggtgttcagtctagtacgagtcgatttgggttagggttttgttcagtgtttgggcctgtgccttcaatgcctcacaagtttcaaattccttcagtgatgggctgctgttcatttgcttcgagttggggtttaggtgcagaaggaagggtttttctctgagttcctacctcccctgtagctttcagctcttaccacgtcattgcacctctgtgggagtcactgtctatgttcttgttcctcccacagaggtcatctgctgttgcgtgttattcacattagaggacagttggaaagtgaggggggcgtgcctgttgtccttaggtaggttctgtgttgctagaccttaagggtgcagcttcctcagggctcttgcacctcctcccacagaggtagctgactgccctgtggtcctcctgtaggatcctatgcccacaaggagagaggaaggtgtcatcttctcctcttcctcagcatcagaggatcttagcctggtcagagcacagggagcatttcctctacatccccaagaggcagagggactttgctgcttctcctccctccaaagtaatggatctttgcctgtgctctggggcagggggaagagggtgtgcaagaaagaaaacaacagtcatgttatacagcgagggccttgtgtagatagagtttatgtagtcataataatgcaagcactgaatgttgagctaaacaaataatataactgtaaggaggatgtgaggatggaagtatttctgttttgggaagccgcagggtgttaaatgatcagttaaattgtcatattccccagtgtaaggtcaatagttaaagcctaagactgaaaaacttaaaatgtcaatgtaaggatgctatttagaaataatgagggccagctgtggtggctcacacctgtaatcccagcaatttgggaggctgaggtgggtggatcacttgaggccagaagttcgagaccagcgtggccaactagcggaaccttaactctactaaaaatacaaaaattagcctggtatggtggtgtgtgcctgcagtcccagctacttggggttcccaagaattgatcaaaccaggaaggcgggggttgcagtgagctgagatcacaccactgtactctagcctgggcgacaagagtgagaccctatctcaaaaaaaaaaaagaaaaaaaagaaaaaagaattaggtaaatattaaataagcttcaaaaagtcacaattctttattctaagaagtggaaactggataggaggaggagaggagacaaagtatggctttttcattaccaagccatggagaactgtatgacattcaaaggtaggcgaataaagatgcttgataaaattaaatattaagttctataaatataaaatttgatacatttaaaactgaattctaaaagtttataacacaagggtagggataaaggtgtagggaaaataggcattctcatatgttggtggagggattccaactggttcaccctttaaggaggtcagtagggcactccatcaaagttccaaattcagtaattcctactacagatatggtagaaaattgtatttcacacttgaatgcaataagactagaaaccatccaaatattaccagtaggtggccgggcgcagtggcacacatctgtaatcccagcactttgggaggctgaagcaggtggatcatttgaggttaggagttcaagaccagcctggccaacatggtgaaaccccatctctactaaaaaaaaatacaaaaattagccaggtgtggtggtgggtgcctgtaatcccagctactcgggaggctgaggcagggaggattgcttaaacccgggaggcaaagcttgcagtgagctgagattgcgccattgcactccagcctggaggacagagtaagactccatctcaaaataaataaagaaaaataaaaataaagattaccaataggtgaatggttagcagctatacagtggaatactatctagccattaaagaaaaaggtgacactttgtgtacttacgtggaatgataccccaggtaagaagcaagatgcagaacggcatcagtgtctctccagattaccagagaaaccagaagtagttttgtttctaaggaaacagggaaataattctcttctaaggaagtgaacttgatagcttagggatagagctgggaggaggatttttttttgccatatacccttttgtgtcttttggattttaaactatttgagtcaattacccatataaagttttaaaaataaaattataatggttaagtacattgggctatttatatggaaaatactttaatttgtttcttagtttccattatatattatacattctgaatggaccatatgactaaatgagagaatcaatatgttaaaaccaggccaggcacagtgggtcacacctgtaatctcagcagtttgggaggccaaagcaggaggattgctttgaacccaggctggtctcatctcgaactcctgtggtcaaatcaacttcctatcccaggagtttgagaccagcctaggcaacatggtgaaacctcatctctatgaaaaatacaaaaattagccaggcgtagtggaacataccagtagtcccagccacttgggaggctgaggtgggaggatcacttaagcccaggaggttgaagcttcagtgagctgagatcgtgccactacactctagcctgggtgacagagtgagaccctgtctcaaaaaaaaaaaaaaaaaaaaaattaaaccttgagaacatatttcttgacattaggattggaaggttgtcttaagagacaaaagcatgtcaaaaagagtaaagatgaagtaatttgtctacactaaaatttaaaaactgacataaaaatgccataaagagaatgctgtgataatcatggactgagaagattgttgaaacacaattgtcaacatttggtatacagattatataatgaacgcctacaaatcaatgaggagaagagttcagggaacacttcaattgaataatgtgcaataaacacaaatagattgatcaggcatagtgtctcacgcctgtaatcccagcactttgggaggccaacatggcagatcgcttgagctcaggagttcgagaccatcctgggcaacatagcaaaaccccatctctactaaaaatacaaaaaaagattagctgggcatggtggcacgtacctgtagtcccagctactcaggaggctgaggtgggaggatcgcttgagcctgggtggcagaggttgcagtgaactgagatcgtaccactgcattccagcctgggcaacagagctagattctatctcaaaaaataagtatttgttaaaaatatgagtaggcagttcacagaaaaaaaaaagctgaactgtggaaaaaaattcaattttgctagtaaccagaggaaagcatattaaaagaaggcattgtttcatatctatcaagttggcaaaagtctgaaaatatgacttcgaggtttgggttggaatgtaaggaaatgtatattgtgattatttgaagtcgtatttttttatagctaggatgacacttcacatctgattttgatagtgtctttttacatgccaatacactatagacatctttctgttttaacatgatacatagaactctgaactccatttctagatgtatttaacaggatatattatccaatgataagactaatttggataggattctttctgagggaaggataatggtatagagaacctcaaggtttttcttagggttttatagtttttcatttttaatgtagattgttttctgcttttttaaaagacattattgcaagagcatctcaagcagacgtcgttacaatcgtgatttggaacaggatgaagcatttattccagttggagaatcactaaaagaccttattgaccagtcacaaagttctggtagtgggtctggactacctttattggtaagttaaacgttcctatagacatgaatggtgtgttgatttagaatgtgtcctcatgatggtggacagtataattattgcagatcagggaacaataatggacacatttttttctccttatttagaaagaggtatgcagtattgcaaggtgaaattagttaaaaataagaaatatgaaccaagaaaaatagaatagtcaagtaagatagagctataaaccaggttataggaaccaagtcctacagagaaaggcaggggaagttagatcacgaagtcctatatgaaaggcaagagttagctcacaagttttgctctaagcattttaccagccaacttaaagaggaatcaggtataagattccttgcatctgtaagtttaaactgattgattgagggaactgtaactatttcagattctgaaataaaaaagaagtttcaacagatattcttagagaggatgcttctctcaatatactactaccaaaacacatagttcaataaaaaataattttaaagggaattacaaataaattccaacaaatttggatggattcttggtatcagggaaaaaaaaataatcccagcaggttcatttatatatggaaatactcagttttgggttgaaggaactcttatttgagaggacctgtattatgaacactagatatccagataggtttaagtttttaattgtattagttgaaagaaactgatctcttcttattttattttattttactttattttattttaatcgtatcgagatagtcttgctctgtcacccaggctggagtgcagtggcccagtcttcggctcactgcaacccctgcttcccaagttcaagcaattcccgtctcagcctccgaagtagctggaattaccagatgcaccaccacaccaggctaatttttttttttttttttttttgagggatgaggtttctccatgttggccaggctggtctcaaactcctggcctcaactgatccttccaccttggctcctaaagtgctgggattacaggtgtgaaccaccgcacccaccctgatctctaattttgaaattcatcttattaaataactctaattgaattggaaaggtaaaagtaaaactgccttcataggcagacaacatgattgtttacgtagaaaatcccaagaatggtacaataaaactactgcagccagtaaatgactttatcaggttgcagaatacagagtcattgtacaaataccattgaatttataggctctagcaacaaacaattaggtaattataaaaacagtatttaaaatagcatcaaaaaccatgaaatatttagaataagcctaacaatttatgcaagacctgcacactgaaaattataaaacattgctgaaagaaattaataaagccctaaataagtggagatgtttataaatctgaggactcagtattaagatttcagttttcctcaaattggtgtgtaatttcattcgaatccaaatgaaaatcagagcaaacttttatagcaattgatgtatattctaacatttatatggaaatgcaaaggactagaagagccaaaacaattttgaagtagaagaacaaagaggaatcactacctgatttctggacttaccgtaaaactcaataatgatctcaatttggtactggcataaggatagatgtattgatgaatggaacagattatggagtttagaaaggaacatgcacttaatatggttaattgattaaaaaaaaaaaaacaaaaagatgcccaagtaattcaattggaaaaaggcagtccatttaacagatggtgcaggaaatatcaggaatccatttaccaagaagttaatctcagtccttacctcctcactctataccaaattaacttgaaatgtagcatagacctaaatgtaaaagttgaagtataaaacctctaaaagaaaatgtctgaaaaaattattctgaccttgggcagacttcttcagtacataaaaaacacaaatcatttttttaatgataaatcaggctttatcaaaatttaaaacttctgctatttagaagacaagaaaatgagaagacaagtcacagattggcaaaacagatctgatacagggtttttgtgcaaaatatataaagaccttttgcaactcaataataagataacccaatttttttaaaaaatggacaaaagatttgaacagacacttccccaaagaagatataagaatgg

SEQ ID NO: 5 - DNA, 192890 bp, Homo sapiens
ggccaggctgttcctgaactcctgacctcagatgattcctgcctcggcctcccaaagtgctgggattataggcgtgagccactgtgcccggccgttttgtcttgttcttaaggaagattcagcctcacagcacaagcatcggctcgtagagtagaaatttcccagacagagagccttttaaaataaaaatatacctctttgaattaccattttgttgctacagcaatgctatagcagtatgaggaggtggtagggggtgggtgggtatttttccaaaaagaaagatgtcttggggcctattaattgccctgcccaaatgttctcactgcagtgtgaccacatcaccagctgttgtctgtctcacttacagaaattcagaaatgctggcatcatcaagacatccccaatgatgagatttctgggtgatgtaaatccacaaacttttaggctttgctttagtcagggtcctggcaggaaaaagatgatgcactcaaactgagtaattggaggaagctttgataagagactgtttagaaacctgtgcgcagggcctaaggactccagcaagggctactgcagtgcctcaaggttgggaacagcttgaccaggaggggcaggagatggaagagattatggaagaggagagtgtagtatatggagagggacactagacaaggggtatggcatttggtgaagggacacaaccaacttatggcagagggcacaacccagcaggaggaaagctggaaatactcacctgccctcacttattcccttccacccatctcctgtggtccttcccgctggccaagcccatctgcaagtgttacagggaaggggtctcgatctacaccccaagagagggttcttggatcttgtgcaagaaagaattcagggcgggtccatagaatacagtgaaagcaagttcattaggaaagtaaaggaataaaagaatggcaacttcataggcagagcaaccccaagggctgctggttgctcattttatggttatttcttgacgatatgctaaacaaggggtggattatttatgccttttgtttttagaccatatagggtaacttcctgacgttgccatggcatctgtaactgtcatggcactggtgggagcgtagcagtgaggacgaccagaggtcgctctcatggccatctggttttggtaggatttagctggcttctttactgcaacctgttttatcagcaagttctttatgacctgtatcttgtgccaacctcctatctcatcctgtaacttagaatgccttaaccgtctgggaatgcaacccagtaggtttcagccttattttacccactccctactgaagatggagttgctctggtttaaatgcttctgacagagcacatgaatgcaatctgtagagtgggtctggagggcaaatgaaagtcatctagcacagacaggtggctgaaataagcaagctaccgatatactatttaatgtattatttagttactcctcaggaattacaatcacatttgttggatatatagcttttccacaaaatgattttatttgctcatggaccatcgggagaaatttcaaggatgttgaaccttaaaaggaactcataggtagatctctccatggaggatccatcgtacagatgcaacaccaagtaaagtgtcttggacaaggtttcacacaagtttatgattgtcccgggagtagagtccaggccactggttctgtttgccatattctgacacccaggacaggccaccacaggccctccatggctctcttctacagaggtgccagaccctgcctgctcatttcccagtttcccagagaaattcaagcagaggtctttctcccacttccctctgtgaaggcctgtgaaaggtgtcagtgagacaggcaggcaggaagggctccctggcagagcctctccccgacctgcacattgggaggagtatacactggggtggagccacagaaatttgtgccatttgcagcggggaggagcctggtccctcctctttctgtgtggaacttgagattcaaactgcgaggcaggaagtgcaccagcagggactctggcctggcggagagtccctgttccccttttgtacctttttgcctaataaatcccattattctcacccttcaaatcacctgcaagcctaacttttcatgggcatgggacaaggaccctgtctttacctgaactaaggaaaagtcctgcaaaagcagggccagggtcctcgactaagggcagacaccagactttgaagtctggctgctctgaggccctgggttccttctgcaaatttctgggcactctatttcatccggcaaaccattgttgggctagaggatgctgctcctgctgttcttgcctgaatattggacatcgggagccaaaagcacagccctggttgcattgttttacatgacttgtaaacttatcctagctcaaggctcagctcaaatgcatcttccttcccctgatagaaatgtgtcacttcttttgcctgaattgaagccatgaatccattgttctgagtcattgtctgtcttctgccatgagcgtgggagcacaggcatcatgtcatgtccatcttggcattcccagtagttggcctcctttcttagacctgggagaacttttgattaccatgtgaatctcctgggataagagctgtattccagagtggaaaaggtgtgattggccttgagagtagagaatgggtgtattagccctgggaagagggggagtgtcagctcctgtattgcaggaaaggcacttctcttgctgggttaggtcaggttgcacagacatcttagacctggcttctggtggagggacaaaggggtaaccaccacagttatgcctaggagacagtggaagagggcgagttactctggtgtgtgcaattctgggtgtggcttccctgaactgctaggaactggtgggaaacactgcaacaggtgtgggagatgctgattatcttagtctgttttctgttgcttaaacagaatacctgaaaataggtaatttatgaagaaaatacaagtatttcttatagttatggaagctgaaaagtccaagggctgcatgcatttagcaatatgcatttcaggttcctctgtgtcttctcatggtttgatagctcatttctttttagtgctgaataatattctaaggcagtgcagggtttcacatggcaaggggctgaacgtgctaatgtgctagttcaggtctctcttccttttctcttttcttttttcttttctttctttctttctttctctctctctctttctttctctctctctctttctttctctctctctctctttctttctttcttctttcctcctcctccttcttcttcttcttcctctttttttttttgagatggagttttgctcttatcacccaggctggagtgcaatggtgcgatcttggctcactgcaacctctgcctcccatggttcaggtgattctcctgccttagcctcccaagtagctggggctacaggcatgcaccaccatgactggctaattttgtatttttagtagatacgggatttaccatgttggccaagatgatctcgagctcctgacctcaggtgatccacctgccttggcctcccaaagtgccgggattacaggcgtgagccactgcacccggactctcttccttttctaataaagccaccagttctactcccatgaaaacccattaattcattagcctattaatccatgaagggattaatctatgatccaatcacttcttaaatgccccacctcccaatactgccacactggggattaagtttccacgtgagttttggaggggacattcaaaccatagtactaacttagacaaggaggaaagccatctctgatggaaggtaccgtgatcttggaggggccacaagtaactgaaaaatcatgttacccaaacctttgattttgtaacataacttagaaagtaaagctcaaaaaagttttctgagctggtggagttacgcagaggccagggcgagaaaccctgggaggacaggggagtggatcagtcagtgtgcagcaggaaacagatgacacactaaaacagggaaattgaggagagtttactgaatgggatcatttacaattgtacgggcagcttcaagggaaaacagcaaaatggtgcagtctcctggggctagtaagaggaggaagctgttggcacccctaggcctgaaagagcaggggctggaggaatctggatagggaagatatagaagagggcctcctcaggaggggatgaagcaaccatggtgccctggcctggactgagttaggagggtaagtactccagcctcactcccctcctgccctctgctctcttgcctgtgcctccaacaggaagcaaagaaactttgctgtagtccacatgtcagcaaaactatagccaggaatccaaattcagcttgccacctgtatttacatgacctttgagctgagaaatgctttttacatttttgaatggttgacaaaaacacactcttaccatacaactcagcagtcatgctcctaacccaaaggagctgaagactatgtccacacaaaaacctgcatattcatgtttatggcagctttattcataatcagcaaaacttggaagcaaacaagatgtctttcagtggatgaatggataaataaactgtagtacatccgaacaatggaatattattcagcactaaaaagaaatgagctatcaagccatgagaagacacggaggaactttaaatgcatattgctaggtgaaagaagctaatctgaaaaggttatacattgtgtgatcccaacaatatgatattaatgtaaaggcaaaactatggaggcagtaaaagaattagtaattgccaggggatagaggggaagaaaagatgaataggtggagcacaacggatttttagggcagcaaaactattctgcatgatactaaaatgatggatacatgtcattatacatttgtccaaactcgtagaatgaataacaccaagagtgaaccctgatataaattacagactctgggtaataacaatgtgtcactgtagattcattaattgtaacaaatgtaccaatgtggtgggagatgttgatttgagggaagactgttgtgggtgggtatatgggaactctgcactttccactaaattttgctgtgaacctaaaactgctctaaaaaataaagtcttttttttttataattccactagatcactggaaaaattaagtcttcttaatcaaaagaagaataatatttcataacataaaattacaggaaatttaaatttctgtgttcataactaaaattttattggaatgcagccacgcccagcccatttgttaatatttctatagctgctttcaggctacaacagtagggttgagtagttgcaacagaaaccatattcccacaaagcctcaaatatttgctaactggcatcttacagaacaactgtgttcttatctatccactttccaaggcacagagtggattgaatgtcgaaggcaaacagaacattttcagccagagtattggtcacaaaggccaaagaactgtgtcaggtagttgtgatgtttttacttttagcgcaacccatgcaacttttagaccgttccattcaagttaccagaatcccatttaggcactgaggtctctctgcttttttacctcagggcttacagtcagtggataattctctaacctccccatcctttggtgggctcattgtagaaggacttcaggggatcgggtgcagtggctcatgcctgtaatcccagcactttggaaggccaaggtgggcggatcacttgaggtcgggagtttgagaccagcctggccaacaaggtgaaaccccgtctctactaaaaatacaaaaattagctgggtgtggcaacgcgcacctgtagtcccagctacttgggagactgaggcaggagaattacttgaacctgggaggcagagatggcagtgagccaagatggcaccaccgccctccagcctgggtgacagtgtaagactccaccaaaaaaaaaaaaaagtacttcagggatccccagtgggaatgagctcagttgccacaccagctcatcaccttgcccttaattagctttcttgcctttgttttctctctttccctcgcctacatttctgcttcctgacataatttcctaagtaaactgcgtacaacttttctcaggtcttggtcttatgggaactcaaagtaagagaataatattgttctatgttgtttaaagcattgcttaattatttggaattccaaacacatgcaaattttctacttatatttttgttattgagcatttaattattttgtgatcagagaccatactctgtggttacttcaagcctttgaaatctattgagacttgttttatggcccagcatatggtcaatttttgtaaaaattctttgtgtccttgaaaagaatgtgaattttgcaattgttaggtgcaatcctttatatatacatgttttaccaagttaattgtgttattcaaatcttatatatctttactgatttttttttctgataattctgtccattcggaggtgtgtgttaaaatcttccactatgtttgtggatttgtgtatttcttattatagttctctcaatttgtgctttatatatttcaaggctttgtttattaggtacatgtaagtttagaattgttatatccttttggtgatttaaattttctatgcttatcactgaaacttttttttgcattaaagtttttttttatgatattaacatactattttatctattgttatacaacaaatcaccctaaaactagcagcttaaaacaataatgacatagttttgcttataaatctataatttgggcaagactcagtagggatagtttcatctctgctccatttagtgttagctgggttggctcaaagactgaggactggaatcatctgaagatttatttactcgtatgtctggtggttgtgtctggttgtgggctggaatcctagctggttgttggcctgaatacctacatatggccacttcttggttcccagggtctgcattctttttttttttttgagacggagtcttgctctgtagcccaggctggagtgcagtggcatggtctgggctcactgcaagctccgcctcctgggttcacgccattctcctgcctcagcctcccaagtagctgggaccacaggcgcccaccaccacgtccggctaattttttgtatttttaggagagacggggtttcaccgtgttagccaggatggtctcgatctcctgacctcgtgatccgcccacctcagcctcccaaagtgctgggattacaggcttgagccacagcgcctggctgggtctgcattcttagagaaagaatcaagcagaagctctattgtgttttatgacctaccttctaaagtcatgcagtaccactttcactatattctgttcatcaaggcagtcacaaaggcctgtctaaattcaggagaaggtgaaatagactcttaatgaaggagtgtaaaagttctggaagaacatgtagaaccagaaatattacttttgcatttttggaaaaacacaattttctacatataactataccagttttattttgatcagtattagtgtggtatacctttttctattcttttactttcaaacttgttatatccttatgttttagatgtgtttcatgtaaacagaatatatttgggttttgctttttcattcagtctgacaatctttgaattttaactaaaacatgtagtccatttacatttaatgtaattatttgtgtatttgggttcaactctaccatcaaactatatgatttctatttgtactgtcttcttagcactccttttaaaaagtattttcttgtgttctttttgcatgagttaattaattttaaattaagacattcatgtttatcttagatattatggcatgtatctctgacttattaaatactaatattaattagaattttacctcttcccaggaatgcaaggaccttagactattttaaccccatttaccacatatacaatttttgtgctatgtgatagattttaattctacatttctttaaaaccctacaagatttttttttttttttttttgagacgcagtctcactctgtcgcccaggctgaatggagtgcagtggcttgatctcggctcactgcaagctccgcctcccgggttcacaccattctcctgcctcagcctcccgagtagctgggactacaggtactcgccaccacgcctggctaattttttgtatttttagtagagacggggtttcaccgtgttagccaagatgatctcgatctcctgaccttgtgatccacccgcctcagcctcccaaagtgctgggattacaggcatgagccaccgcgcccggcaaaaccctacaagatattataattgttgtcttacacagccaatattcattagacttatccaaataactaccatttcattggttttcttttcttcctgaatctccaatctttcttctagaatcatttccctctatctgaagagatgagacctgtttagtttttccttcagtgtggtcttctgaaagcaaattattttgtttttgtttccctaaaaatgtgtttatttaaacttcattcttggctgggcatggtggttcatgcctgtaatcctagcattttgggaggctgaggcaggtggatcgcttgagcccaggagtttgcgaacagcctgggaaacatggtgaaaccctgtttctacaaaaaatacaaaaattagccgggcatgatggcaggtgactgtagttccagctactcaggaggctgaggtaggaggatcacctgagcccaggaagttaagactgtggtgagccgtgatcatgccactgcaatgagtggcatgagtttgggtgggagagtgaaaccctatctcaaaaataaaaataatattttttttgagacaatcaccctctgttacccaggctggagtgcagtggcacaatcttggctcactgcaacctctgcctcttgggttcaagcaattctcctgcctcagcctcctgagtagctgggattagaggtgcccaccaccacacccagataatttttgtatttttagtagagatggggtttcaccatgttgaccaggctggtctcacactcctgacctaaagtgatctgcccacctcagcctctcaaagttctgggattacaggtgtgagccagtgtgcccagccaaaaaatttcatttttgaaggatattttactaaatataaaattctaagttgttaattattttcttttatcacattaaacataatttcactgtcttctggattttgtagttgctaataagaaatcagttgtcagtctgtctgttcctctgaagataatctacttttttctgttctgcttgtttttaaaattttctctttatttttggttttctgcagttttacaatgaagcatctgggtgtgatttatgttaatgctgtgtatggctggatgtagtggctcacccctgcaatcccaacactttgggagactgaatggaaggattgcttgaggccaggagttcaagaccagcctaggcaacttagcgagaccctgtctctacaaaaaaaaaaaaaaaagaaagaaaattagcagagcatggtggctcatgtctgtatccccaactactcaggaagctgaggtgacagaatcacttgagcctgggggttcaaggctgtagtgagctatgatcacaccactgcactccagcttgggtgacagagtgagactctgcctctaagtaaataaataaattaagtactgtgtgtgattttgggggcttcttgaatctgtggactgatatctttcatcaccatttctgcatcatgtccttgaatcatcagttctggaagtctcattcattattcaagtattgcttttgccctatttcttctttcttctggaattccaattaaatgtatattggtctttcttactgtgccctctatgtctctgatcttctcttccatttgtcatccatttatctctctgtgctccattctggatgaattcttctaacttgtcttatttatttactctgtttttagactcatccattgagtttttaatttgtgttattatgttttttagttcctgaatcttcaatgtctgtttttatagtttccaatattttgctgaaatttttgagttcagtttttaaccctatgatgatagtaagatagttttttccccctcatctctgtctaataattccactatctggagtatctgtgagcctctttctgttttctattgttcctgcttacttttgttcttattttatttcttgttatgcctggttatctttgattgtgtgttagaaactgtacttgaaaaatttattggagcaattttagtactaggatgatatcatcttcctttagaaatgattttcatttacttttgcaaatgtgtggggacattagcaatccaggaccattgtaatccattttagtgcttgagatttttctgaatcacccagatttcttgaaactgagctacagtaaaggggaaggctagtttactttttgtttacttttactttcagggtttagtcaatcaaaattccacttctaaagtatggggtggttttccagagttacccttcccttggaaaggccgagcctcctcagtgttttaactaccttttctgattgacaaaagtggcccaaatgctgagctcttctctctggatttctaccaagggatattgacccttgacaatttcttgcaacttgttagcttttctttgttttagaaagaagctttttgtttgtttctggtttgttttgagacagagtcttactctgttgcctgggctggagtgcagtggcacaatctcggctcactgcagtttccacctcctgggttcaagcaattctcatgcctcagcctaccgagtagctgaggctacaggcatatgccaccatgcctggctattttttgtatttttagtagagacagggttttgccatgttggtcaagctggtctagaactcctggcctcaagtgatccacctgcctcagcctcccaacgtgctggggttataggcatgagcctccacacctggccagaagctttttatattccatatggattatttcagttgtgtttggtgggagggtagttccaaattatctagttaactatttctgtatgtgaaagttctctacttgctctaacattgaagaataccttggtatctctttaggggactgatgaatgcaggaggacaaataccacagatgatctgcaatcgtatataataatacaaagtagactgattttgagtttttttcttgtaattcaatactgtggcccttaaaactgtacataataatttgctccagaatttctgatcccagaaagctgcctatggaaataattaattatagatgtttgaaattattcatttataaaggaatttttaacaaaactggtaattaacagaagactagttaaaataaaataggcttctctcataggataagatattgcacagccattaatactataggataatatctaatggcatagagaagtcataccataatgagaattgaaactagtcaatcataatatgaacccttttaatatagttacatatgctggaaatatcactgaaaatatattgactaaaatgctaaaagtggttatctcagggttgtgagataactagtgcttttatctactgccttttgctttttaatatttttgtaattttgaaaattatatacttataattttctaaaatgaacatttatcacttttgtaatggaaagtgaactacaaaataaaatgctacaagtgaaaccagatgtttttattatgttgtgttggaaaatttatcaatgtaaatagcccataatttagattaaagaagtctttttgaatatctaatatatgtcagcctctttcatacatatattttcactaatgcttataagtgctcaattttcagtcacaatgtagtaattagtaattgaaacaatctagactgttcaaaaggaagtcaagtggacagattgattggtacaaggtgaatggtatgattttcatagtcagcaaattcctccaacaaaggccagataatgggcaaggtgagctcttccagacattataatttaccctaataggatagatgttgagttataaaaatgtcataaatactgtaaaaatgagaaatatgagaatggaaaaataacagcaatattcatatactctactgcagcaatagttaacatcttggaatatgcaggtgattggattattgattccaaccatctgcttcctttcctgtaagaggattatacatgtgatctgcagtggctttccaaagtcagagtatagttctttgacctgctttggccaatgggatgtgaacaggagtaatatccaccacagatgagccaaacctttaagagctattagatgtttcagctctatcctgtttgtttccctttgccacaagaatgacatgtcctaaaaagaggctgctccttcaggctagccctggaatgagatgatacatgaagcagagccaccaccactgatttgcagacaccaacatgcaatgtgaatgagaaataaatgtatattatagtaagccatgagattaggtggtggggggtgctgtttgttatcacagcaaagctgactaatacattgtttcctcaaaaatacaatagcagctctcttaaccaagctccacttaactgactttccagattgacacatgttctcctttccttcctttttttttctaacttttcttttgagaaagtcttactctgctgcccaggctgaagtggagtggtgcgatcataactcactgcagcctcgacctcctgggctcaagaaatcctcccacctcagccttccaagtagctgggactacaggcatgtgccaccacgcccagctattttttttttttttttgagatggaaacttgctctgtcaccctggctggagtgtagtagtatgatctcagtttactgcaacctctgcctcttgggttcaagcaattctcctgcctcagcctcctgagtagctgggattataggtgcaagccaccacacctggctaatttttgtattttttagtagagacggggttttgccatgtttggctggtctctatcccctgccctcaggtgatccacctaccttgacctcccaaagtgtgggattacaggtgtgagccaccatgcctggccagccaatttttaaattttttgtagaggtggggtctcactatgttgcccaggctggtcttgaactcctgtgctcatgtgatccacctgcttcagcctttcaaagtgctgggattacaggcatgagccactgtgcccagctctcttgtctgtctttaaaacatattgacaatgtccatggcacattgcatactcaaagcttgtaggccactctccaggataggtgctcactgctgcctgatcaactgaccaagtgcaagtcctaatccagatcaagacaggtgagagggttgtgcaacaaaccagtttgaggttctggagtggttggctgtgacgcagtatcacataattgtcaagtgagagagcttgggaataaagctatgcaagaccagatcccaactctacctttagggggtgtgtgcctttggtcaaattattgagagacaggactagctggattttctaggccaactaagaatccctaagcctagctgggaaggtgactgcatccacctttaaacacagggcttgcaacttagctcacaccattcaggtggtaaagagagcgcactaaaaagctaattaggcaaaaacaggaggtaaagaaatagccaatcatctactgtctgagagcacagtgggagggacaatgatctggatataaacccaggcattcaagccagcaacggctaccctctttgggtcccctccctttgtatgggagctgttttcactctattaaatcttgcaactgcactctcttctggtccgtgtttgttatggccggagctgagctttttagctcaccgtccaccacggctgtttgccgcctttgcaggcctgacgctgacttccatccctccggttccggcagggtgtccgctgtgcttctgatccagcaaggcgtccattactgctcccaatctggctaaaggcttgccattgttcctgcacggctaagtgcccaggttcatcctaatcaagctgaacactagtcactgggttccacagttctcttccatgacccatggcttctaatagagctataacactcaccacatggcccaagattccattccttggaatccctgaggccaagaaccccaggtcagagaacacgaggcttgccaccatgttgggagctctgggagcaaggatcccccggtaacatcactaacacagacaccaatattgagagttactggttttcaaagaattcaaagaatctttcagtgaagaagaaattgttatctggtttttataatgcttctcatactacaattacctaagtttaaaaaccaaacttttgcaaatattttattttgttttatttttcactgtggaggatgtcatacttaaaattagagaaaatggcataatcctcccccaggtactcatgacctagcttgactaatcatcagctgtggccaatcttgtttcccctagtcacttgtctccctattccaacacatacacgcgcttactccctgtcttctcttcaattcttgcactgggctgtttaaaggaaattctagacatcgtaattttttttttttttttgagacagcgtctctctctgttgcccaggctggagtacaatggcatgatctcggctcattgcaacttccacctcccaagttcaagtgattctcctgcctcagcctcccaagtagctaggactacaggcatgtgccaccatgcctggctaatttttttggatttttgtggagacggggtttcaccatgttggctaggctggtctcgaactcctgacgtcaggtcatctgcccgcctcagccttccaaagtgctgggattacaagtgtgagccactgcgcccagcctgttgctatgactcttaaaacttttctcaaagtttccctctttttttttttttttaacataacccctgtaaatcctttgtccatgagtaatccgttgtgaccatgttgcaaatgtcagggtccttagcttttctcaccctttagtgaacactgctttgggtgttcccttggtgtcaggccagcctcacacctccggtgagtggtcacgcaggcaaccatttccacctacgttaagtgcatcatctgaaaactcatttccttgagacctttatgatagtaagtagggaattgaactcctcaaggctttttggtcttgttggtctcaagaaaggaggttttcaagaaacctgttggatgactcaacatgaggctccaggggtgataaagaccctgaggtccctgatccatgtagaagttttagaaataaaattgtttcagaaaatgtagaatgggcaaatgcagcatgtataaatggaaatattactttctatgatatgcaatttaaagtgtgagtaactaaataaactagatatacataaatataactattttttcttttcttttttttttttttgtgacagagtctcgctctgtctctcaggctggattgcagtgtgcaatctcggctgactgaaacctttgccgcccaggttcaagcaattctcctgcctcagcccccccgagtagctggaactacaggagggcaccaccacgcccagctaaattttgcatttttgtagagatggggttggcttgtctctataccatgttgaccaggctgttctcgaactcctgacctcaggtgatccacccacctgggcctcccaaagtgctgggattacaggctgagccactgcgcccagccaacataactactttttctatgactcagaagttttgtatacttgtgatgaactaaagttggaaaaactgagctttgcataaggagcagtcttgcctggggttacataaggtgctgttccagttataagacagactcatgccctgagacggccccgcctcccctcgtcctgctacgttatgtctttgactttgtgaagtcactcctcctgtcactgcccttgatcaggtctctcacatgcctcacataaagaactctgtgaagatcccctggatttggtccctggttattggccatcccctggtaccatccggtttacctgcttttatctgagtctctgctggcttcccaccaactcacttcccctagctgcacacacccttcatgctacgtgggagcaattgttgacatgaaaattcaaaaagatgagacaaatacaactccaacaacctcaagcctcaagagtcagagagttaacttccttttcatttcctcccttagccaggaggggtgttccagtggcttctgcttggcttttcctactgcaatagacttatcctctaagtcagggagcaattccatggcagtgaggccatctgctccatctacacatccaaaaactggagaaatgaccctgaatgattgctgctgccctatgccttggggctgttgttgactctgattagtttcatttatcacctgatactgtgagaaccctgattggtgaaccaacctggtggtctgtgtatcaaggaattgcttttatcacagagccacggtcaattgtaacagaaaattttggggattactcttcacttggcacagttacctgccaaaatcatcacagattcttttgtggaagactagcagaaaggtgcacactatgtacttgtcctattaaagctcgccaggggcctcttaagtctggaaatggaatgggtgaggggctgcaactctcgtgaagctgggcctcaagttaccagacctaggtacatttgattatatggttcatatgcaattggagtaatgctgttgaccaaatatttcccatgctccacctttggggcacatggttagttgcacttcctggttctgttgtggttgggtgggaccacatggctagtcctggccaatcagttgtaaacagatgatgtgcgtcacttcagggccagagcatctaattaccaatttatcaccctctggagctctctgtcttttcgtttttgagttgggcaatgttcaagattatgactgctccatcagcctagttcctagcatgaaaagatggaaagtgaagaggccccagcaacaaataaacatccagcacgaataagaaataaatctttcttgttattatgttattctatgttatgttattctatgtcattatgattttgacatagcctagcatatcttgattgatacaaaaattgatgcctagagatgaaggatctttacaaaaaccgggttttgtggcattggcttagggatcaggtgatggggcaaggaaactaattttggaactggttttccattggtacatttgacaaaaccatcacccacaataacttgaaaggtagataataaaccttgcatgcttgtagctccaggagaagagactagaaaacaaaatattaatgttggctgcatatgacatgctaatttaaggaagagatgtaccaagaaaacaatgaattaatttgtagggcaggaatggaagggaaaagagagtatagaaactcaggaatttgcaggattgggagtcgattttttttttctttttttttttttgagatggagtctcgctctgtcgcccaggctggagtgcagcggcgtgatcttggctgactgcaaactccgcctcctgggttcacgccattctcctgcctcagcctcccaagtagctgggactacaggcacccgccaccaggcctggctaattttttgtatttttagtagagacgggatttcatcgtgttagccaatgtgttttatttccaattaataaactatagaatttagaggaagtttaaacaacaaaaaagactattagaactcatatttcaggcaaggatccaaccaagattatttctgtcacatccatcattaaaatctctgaatagatttagttgtcacccagtaaatcctctcaactggatgtaatggttcaggaagaaaagaacaaaagtgctgccctctgtattagttcgccagggttgtcataataaagtaccagaaactgggtgatttaaacaacagaaatttgttttctcacacttctggagactagaagtgcaagatcaaggcgttggcagggttggtttcattatgaggcctctctcccttgcttctagatggccatcttcttcttttgtcttcttattgtctctccttcatgtgtgtctatgtcctttttttttttttttttttttttttttttttgagatggagtctcactctgtcgcccaggctggagtgcaatggtgccatcttggctcactgcagcctccggctcctggattcaagcaattctcctgcttcagcctcccaagtagctgaaattacaggcacatgccaccacatccagccaatttttgtatttttattagagatgggttctcaccatgttggccaggcttgtcttgaactcctgacttcaccatgccttggcctcccaaagtgctgggattacaggcatgagccaccactcccggccttgtcctaatatatttttataaggacactggtcatactggactagggtccaccccatttacctgatttgaacttaattatctctttaaagaccccatctccaaatacagtcacattcagaagtattgggagttagaacttcaacatgtgaaattcaggaagatataatccagccaataacactctctcactgtattagtccattctcacactgctataaagaactacctgaggctgggaaatttataaagtaaagaggtttaattgactcacagttctgcaggcttagtaggaagcatgactgggaggcctcaggaaacttacaatcatggcagaaggtgaaaaggaagtaagcaccttcttctcatggcagagcaggggagagagagagagtgaagggggaagtgccatatacttttttattttatcttattttattttattttattttattttattattattatactttaagttttagggtacatgtgcacaacgtgcaggtttgtaacatatgtatacatgtgccatgttggtgtgctgcacccattaactcgtcatttagcattaggtgtatctcctaatgctatccctccccctccccccacctcacaacagtccccagtgtgtgatgttccccttcctgtgtccatgtgttctcattgttcaattcccacctatgagtgagaacatgtggtgtttggttttttgtccttgcaatagtttgctgagaatgatggtttccagtttcatccatgtccctacaaaggatgaattcatcattttttatggctgcatagtattccatggtgtatatgtgccacattttcttaatccagtctatcgttgttggacatttaggttggttccaagtctttgctattgtgaatagtgccactataaacatacgtgtgcatgtgtctttatagcagcatgatttataatcctctgggtatatacccagtaatgggatggctgggtcaaatggtatttttagttctagatccctgaggaattgccacactgacttccacaatggttgagctagtttacagtcccagcaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcacccactttttgatggggttgtttgtttttttcttgtaaatttgttggagttcattgtagattctggatattatccctttgtcagatgagtagattgcaaaaattttctcccattctgtagcttgcctgttcactctgatggtagtttcttttgctgtgcagaagctatttagtttaattacatcccatttgtcaattttggcttttgttgccattgcttttggtgttttagacatgaagtccttgcccatgcctatgtcctgaatggtattgcctaggttttcttctagggtttttatagttttaggtctaacatttaagtctttaatccatctcgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatacacggcataatttctgagggctctgttctgttccattggtctatatttctgttttggtaccagtaccatgctgttttggttactgtggccttgtagtatagtttgaagtcaggtagcatgatgcctccagctttgttcttttggcttagcattgacttggcgatgcgggctcttttttggttccatatgaactttaaagtagttttttccaattctgtgaagaaaatcattggtagcttgatggggatggcattgaatctataaattaccttgggcagtatggccattttcccgatgttgattcttcctacccatgagcatggaatgttcttccatttgtttgtatcctcttttatttcattgagcagtggtttatagttctccttgaagaggtccttcacatcgcttgtaagttgaattcctggtatttcattctctttgaagcaattgtgaatgggagttcactcatgatttggctctctgtttgcctgttattggtgtataagaatgcttgtgatttttgcacattgatttcatatcctgagactttgctgaagttgcttatcagcttaaggagattttgggctgagacaatggggttttctagatatacaatcatgtcgtctgcaaacagggacaatttgacttcctcttttcctaattgaataccctttatttccttctcttgcctgattgccctggcgagaacttccaacactacgttgaataggagtggtgagagagggcatccctgtcttgtgcccgttttcaaagggaatgcttccagtttttgcccattcagtatgatattggctgtgggtttgtcatagatagctcttattattttgagatacatcccatcaatacctaatttattgagagtttttagcatgaagtgttgttgaattttgtcaaaggccttttctgcatctattgagataatcatgtggtttttgtctttggttctgtttatatgctggattacatttattgattttcatatgttgaaccagccttgcatcccagggatgaagcccacttgatcatggtgaataagctttttgatgtgctgctggattcggtttgccagtattttattgaggatttttgcatcgatgttcatcaaggatattggtctaaaattctcttttttgattgtgtctctgcctggctttggtatcaggatcaggtctcatgagaacccattcactatcatgagaatagaaagggagaaatctgcctccattatccaatcacctcctaccaggcccctcctccaatttgacatgagattttggcagggacacaaatccaaaccatattactcaccaagcatgatgggctcctttttcctggtacgaaatagacagataggtggagctgtgtcaagaaaagaatggtgggccaggcttggtggctcatgcctgtaatctcaacactttgggaggctaaggcaggcagattgcttgagctcaggagttcgagaccagcctgggcaacatggtgaaaccctgtttctaccaaaaaataataataataatacaaaaattagccaggcatagtggcatgtgcctatattcccagctacttaggctgaggtgggaggatttcttgagcccaggaaacagaggttacagtgaactaacttgtgccactgcactccagcctaggtgacagagtgagaccctgtctcaaaaaaaaaaaaaaaaaagaaaaaaaaagaaaaaaaaaaaaaggaaaagaaaagaactatgtgccaggagcagtggctcatgactgtaatcccagcactttgggaggctgaggcggaaggatcacttgaggtcaggagttcaagaccagccaggccaacatggtgaaatcctgtctgtaccgaaaatacaaaaaattagttgaacatggtggtgcacacctgtaatcccagctacttgggaggctgaggcatgagaatcacttgaacccaggaggcagaggttgcagtgagccaagatcatgtcattgtactccagcctggtgacaaagtgagattctgtctcaaaaacaaaacaaaacaaaacaaaaaactattaatatgctgttgcaaatgaagctgattagaattagatagtgccacataaataaagaacctggatatgacattaaatgttccttaaaaacctccagcattcttttttttttttttgagatagagtctcgctctgtcacccaggctggagtgcagtggcgtaatcttggctcgctgcaacctccacctcccaggttcaagtgattctcctgcctcagcctcctgagtagctaggattacaggcgtgtgccaccacacctggctaatttttgtatttttagtagagatggagttttgccatgttagccaggctggtcttgaactcccaacctcaggtgatcaacccacctcggcctctgaaagtgctaggttacaagcatgagccactgagcctggaccaaaaaaacccctccagccttctatagacaagaaacaagctcagaacactgctcagcttccaaagagtgcagtctccaatgcccactcctgaaaatgccaaacaggataatagaaagggaggcaccctttcccagaagctagtcaaaaggtatagagaataatgaattgggaacccctcctaaagataagaataagtgtctaattcaaggaatattttctacacacagggcagcaggacctcacagtatcttgccatggaccaatgttcattctgtatcttcattcattcccttttgatggaatgtctttgtggtaacctctctctgttccatcattgtgtattggatttgtaaggagcagataatttgtctttttagttcatagaatctttcatgttgaaatgaaaagtcactagacagtaattttcagtcatacaaaaatataaagatctctagtaaatgcatgggcaaatatagaaatcagtattattgtaattttggtttgtaaatcactttttatcttccacaggatttaaaagacaaatacataaaaattacaaatctatattaattagtacacaatgtataaagatgtaattttgacattaataccataaagtaggggaaagaagagctttataggagtgtttgtatggtattgaaattaagtttgcatcaatttaaattagattgctataactttaggatgttatatgtaatccccaaggtaatcaaaaattgttctatcaaaaaatattgatataactaatgcaggaacagaaggccaaacactacatgtcctcacttataagtgggagctgaacaatgagaacacatggacacagggacccctggggactgttgtgggggtggggcattgggggagagagcatgaggaaaaatagctaatgcattctgggcttaatacctaggtgatgggttgataggtgtagcaaaccaccatggcacatgtttacctatgtaacaaacctgcacatcctgcacatgtaccccagaacttaaaataaaataaaataaatattgatagaataaatacaaaaggaaatgagaaaggaatcaaaatgtggcactgaaaaaatgtaactaaacacagcagatgagagtaaaggagcaagtaagagccaacaaagctataagacatacgaaaacaaataataaagcagcaaaagcaaatctttccttatcagtgattactttaaacataaatgggttaaaatccccagtcaaaaggaatagaacggcggaatggactaaaaaaaaaacatgattcaactgtatgctgtcaataagagactcattttagagctaaggacacaaacagatagaaaatgacaggatagaaaaatgtattccatgcaaatagtaactaaaagattgactggggtggctataataaaatcagacaaaatagacttcaaattaaaaatggttactagagacaaaggaagacattatatattgataaaatggttaaaacagcaataagatataacaattataaacatatgaaccaaacatcacatctccaaaatatatgaagcaaacactgacagaattgaggggagaaacagacagttctacaataataattagacacttggccaggtgcaatggctcatgcctgtaatcccagcactttgggaggctgaggcgggcagatcacctgagatcaggagtttgagaccagcttgaccaacatggagaaaccccatctatattaaatacaaaaatagctgggcgtggtggcacatgcctgtaatcccagctattcgggaggctgaggcaggagaatcacttgaacccaggaggcagagtttgcagtgagctgagatcacaccattgcactccagcctgggcaacaacagcgaaactccatctcaaaaaaataaaaataaaaataactggacacttaaatattccactttcaatgatgaataccacaaccagatcaaagatcaataaggaaatagaagacttgagaaatactgcaatggacagaatgtttatgttcccccaatattcatatcttgaaatccaaccccaaacataatggtattaggaggtggggactttggaaggttaggttatgacagcagattcctcatgaatgagaacagtgcccttacaaaagagaccccagacagatccctcagtcctccaaccacatgaggtaacagtgaaaagatagctgtctacaaggaagcaggccctcaccagacgccaaatttactgatgccttcatcttggacttccaagcctccagaactgtgagaaataagtttgcattgttcataagccacccagtttattatgttttgttgtaacagtctaaatagactaaaacaaacactataaaccaactgaacctaacagacatgtataagagaatataacatttttctcaagagcacatggagcattctgtaagagagaccacattataggtcacaaaactagtcaataaattttaatagatggaaatctattaaagtatcttttttatcacaatagaattaaactagaaatcaataacagaagaaaagctggaaaaatcacaaaaacatggatattaaacaacatactcttacataaccaacgggtcaaaaaagaaatcacaaaggaaaatacaaaatatcttgagacaaatgaaaacaaaaatgcagcatgccaggctgggtgtggtggctcaggcctgtaatcccagcactttgggaggtcaaggcaggcagatcgcttgagttcaggagtttgaaacccgcctgggcaatatggtgaaaccccgtctctaccaaaaacacaaaaaattagccaggcgtggtggtgcatggctgcggtcccagctacttggcatgaattggtgggaggatggcttgagcctgggagacagaggttgtagtaagccaagatcgtgccactgcactccagcctgggtgacaggtaataatctgtttcaaaaagaaagaaaaaaaaaagcagcatgacaaaacttacaggagcactcctaagagggaaatttatagctataaatgattacttaaaaaaggagaaagacctcaaatcaacaacctaactttacaccttaagggactagaaaaagcacaaattaaacccaaagctgtcagaaggaaggaaataatagtcaagcagagacaaataatacaagaaatagaaaacctatggaaaagcactgaagacaaaaggccaatattttatcatttcacttatatgaggtacctagaataggcaaagtcatagattcagaaagtagaatagcggttaccagtggctgttgtgaagggagaatagggagttattgtttaatgggtgcagaatttcaatttttaaaaattctagagatggttagtggtgatagttgcacaacaattttttttgtttgtttgtttttgagacagagtctggccctgtcgcccaggctggagtgcagtggcgcgatctcggctcactacaagctgcgcctccagggttgacgtcattctcctgcctcagcctcccgagtagctgggactacaggcgctcacgaccacgcccggctgattttttgtatttttagtagagatgggctttcaccgtgttagccaggatggtctcgatctcctgacctcgtgatccacccacctcggcctcccaaacaatgttaatatacttaatgccacaaaattgtatacttaaaaatggttaaaacgatacattttatgccatgtatattttatcacaatttaaaagatcattcatcaggatcaaacaatagtcttcagttaagctccatgctttcagataagaatttagggaactgattttgtcattatgttctaagttatacatttggaagaagtgaccctatgctgggtggtttgaattcctcacacccctcataataatctatggaagatggtatttgttctcctagaatcttggcctcaattggacacttaattttatttgactagaagcaagaacttaactcttttttatttacttttaattttttcgctgctccaaaggtacatcagggaacttaactcttttgtaactagatggaaaaggctactagattcccactctggaatatgaatgagaatttcactgtcctattttcatggcgtcatgattgccaaacaccttctcttcccttggggttttagccctcagtccattcttttttaccactttctatgtcatttgagattctgggatacaaaataaacaaacaaacaaaaaccccagccaattctgaataactgaagcaaagtatatttatgaattagaggaataatctattttgaatatgctttccaaacagatgggcttgtaaatagaagtgaccaaaagagctatagaggataaagaagaaggaaagaggaaatgtagcaaatgtcctctgctcatcagctacactggctatgctgaaaggcttcttttttttttttttttttttttttgagacagagtctcactctgtcccctaggctggagtgccgcggcgcgatcttggctcattgcaacttccgcctcccgggtttaagcagttgaagtgattcttgtgcctcagtctctggagtagctaagattacaggcacgcaccaccacgcctggctaacttttatattttcagtacagacagggtttcactatgttggccaggctggtcttgaactccttacctcaggtgatccactcacctcagcttccccaagagctgggattataggcatgagccactgcacctggccatgtgctgaaaggcttctgacttatcctagtgttcttgcaatattagctcaattttcaaagattcagaaaaaaaaaatctgattgatcaaactgaggtcacgtgtccagcatcctggttctaccattatctatgtgctacttctgtaattggtgacagaaaatcgacaaaaaattatatatatttatcaggtgtaacatgatatttggaataagtatacattctttccataggagattttaaaaaagaaatacctatatattgtggaatggctgaattaagctaattaacatttatattacctcatacacacataaacagaaaagaaaaaaaaaagcagatatatttccaacaggcatccaatagcctttatgccattgtgtgttgtaactctctgagagatggaaatggtatctggcatttcccacacttctgaagcagggtcccacagagaatggtttggaaaaaccaaagtgaggaggtaactggacttttccttccacacctagattatctccctacacagagtaagcagttctatccagcatgcacttgtggaactaccaggaactacccatttctatgggcaaaggatgcttctcagggacctctggtttttgcaactctcccacctggcattccataaaggtggttcccatacccttgctgaggccagcattcatcctgggccacctgtcctgtctcacctcataccaaattgttcactgattctgatatgctggcctccaaccttgcacagatcttctttacttagcctcatctcaccccttataactgaagctggaaattgtacttctcacttcctctgaggtacgttgaataactagtcccaactctttaacccgcgctgctttcatattcttgaaagtgcctcattgttgggagtcaaaaatctccagctctgaggatttatttatttactcttttatttctgtcctttttttctcagtgtgttttgaagcttaaaattttttttaatttttttcatagaacagccaaatccaattttttaattttaattaaaaaaatttttttttcatagaacatgaagctttgttattatgtatatacacatttaggattctcatgttatcttgattaattaacccttttatcattatgaaatgtccctctttatctatggtaatatccttaccttaagatgtctttgataatattaatagtataggcatgccagttttttttttaataattagtggttttagggtagagcttatccattttgttttcaactcatatcttctgtaaataacagtaatgttttgctcttttatacagtttcccaatttattccttttatttaatttgtttttcacttaatgtaatttttatgtggttgggtttaagaatacaatcttgctattggtttatttgtgctatttgttctttgtattgtctctcttggtttcttttgggtcaaaagggcattatttttttagtaccacatttcatctcctttattggtattttatctacagctctttctactatgtttgtagtagtttctctgaagattacaatatgcaaacttaatttatcatgtctactttttcttttttttctttctttcctcttttgagacagagcctcactctgttgcccaggctggagcgcaatggtatgtgcgatcagggctcactgcaacctccacctcctgggttcaagtgattctcgtgcctcagcctcccgagtagctgggactacagttgtacaccaccacacccagctaatttttgtattttaagtagaggtggggtttccccatgttagccaggtttgtcttgaactcctggcctcaagtgatctgtctgactagacctcccaaagtgctgggattacgggtgtgagccactgtgactggcatatcaagtctactttgtattagtattataccatttcaattataatgttagaatcttaagacaggatactcccacttaccctctctcattcttttccttcaaataatgaataatttcatgttggaattattcaaataattttctccccctacctccttgtctaatcctttccttctggggctctgattataggtatattagatggttttacagtgtcccacaagtcattgagattctgttcaattttcttttcttatttttttggcagagtctcgatctattggccaggctggagtggagtgcagtggcgtgatctcggctcactgcaacctccatctcctgggctcaaacaattctcctgcctcagcttcctgagtagctgggattataggtgtgtgccaccacgcccagctaattgttgtatttttagtagagatggggtttcaccatgttagccaggctggtctcaaactcctgacctcaggtgatccacccgcctcagcctcccaaagtgctgggattacaggtgtgagccaccgtgcccggcctctgttcaattttcttgatctctattctttgttcttcagtttagataatttttgttgactgccttcaagttcattctttcttctgcaggtctaatctacttttaagctctttcaatacatttttgatttcagatattgtatatgtttattttaggatgtggttcctttttttagtttccatatctctccttagtttccatatctctcctgaaattcctgtcttcttcttttttatatttatcttttcccatacattctttaatatatttataatactttaaaattcttgtgggccaatttcaacacttgtgtcatttgttggtctgcttctagtgacaatctccctctatattgtaggtcacatttttctgctttttatcattgctggcaagtttttattgccttctaaatatgtggttgatacattttagagactttgaattcttccatcttccgcttgagaattttttttgttcttggaggaagtttaatcacaagcacatcattttgatcctgcggaaacttgattttagacttttcagggcaggtctatttcaattttgcctttagtactcaggcatagtccttagtcctggaagtagccgttactcttaggtgtgtcctttctggggttttaatggaaagccaaagtgtttaccaagtttttcctttttaaaaagtaattaagtttttttgccaggcacagtggctcatgcctataatcccagccctttgggaagctgaggtgggtggattgcttggagccaggagttcgagaccagcctgggcaacatgatgaaacctcatctctacaaaaaaatatataaaaattagctgggcgtggccaggtgtggtggctcacgcctgtaatcccagcattttgggaggccgaggcggatggatcatgaggtcaggagttcaagaccagcctggcccatatatagtgaaacactgtttctactaaaaatacaaaaattagctgggcatggtggggcacacctgtagttccagctgcttgggagactgaggcagaaaaatcgcttgaacccgggaggcaaaggttgcagtgagccgagatcatgccactgcactccagcctgggcaacagagcaagactctgtctcaaaaaaaaaaaaaaaattagctgggcgtggtagtacacacttatagtcccagctacttgtgaggctgaggcaggaggatcacttgagcctgggaggtggaggttgcagtgagctatgatcacacctctgcactctagcctgggtaacagagcaagacactgtctcaaaataaataaatattaaaaattgacaaaaattatatgtatttatcatgtataacatgatatttggaatatgtacagatcctttctgtaggagatgaaagaaaataaaagaaatatgtatacattgtaaaatggctaaattgagctaataaacttttatattacctcatatacttatcatctttttttggtgagaacacctagaatctattctcttagtgattttcaagaatataatactgtactttgtgactaactatagtctccacattgtaaatagatctcttgaactgcttccacctgtctaactgaaactttgcctcctttgataaccatgttccttacccccacgtccacctcccaagatcatctaatgtgaattgatcattcaataaatgttgttaaacacttaaagagctgattctgatctatttttataagagatatcactttcgccaaaatctcggatattaacttagagcaaagatttaatagttttaaaaaatcagccataacaaaataacaaaaacaataatataaacaaaaccaaacctaccaatcaagaaattatagagtctattttcataatttcatagactgcccaagcatttcagcaaaacaaagccacactgaaaaatattgacaagtttgtatgcataaaactgtaaatcttgtttatgggaaaaaatgcaataagcagagttaaaatttaaatgacaagccaggaaaaaatatttgtgattgtgtatgacaaacaagaagttaatattacttgatgggatctgagctctgcactgtttctctagcactgggcagctgttgaaacctcttgtcagtgcttgctttcctctggattccttggagtcttgccctgtactggtgcagcttaggagtcagccaagaattcgagacgagttatatacagatttgggggttctccctctgttggtctcttctttctggaattcctccccacctcctcaatttcagctgctctggaagccctgattctggcctgattcttcatcccagcctgttggcctctttctgctggagttgtatccacacctcaccccactcccacctacaccactccagacccccagcaccgcagagtcttgggggtaacctcagttactgatcaaaatcagttctttaaatgtttaacatttattgaataatcaatcctttattcacagtttaaaagtgtagctctatcatatttaggtgactagatgtgctgatttgtttctgatgtctgttcgttctgttcccttaatctgtttatttatccttctgctagtctcacaatgttttattacagtaattttcttgaaggaaaatttgtattattttaattatttttatgtacagaaaactcaacagtgtatatttaacccagtttaatggcaaattctttagcctttgcctttttgagcttggcgatgcgaaccacagacttgggacccaggacattgccgccccagtgatggcggatctcatcgtatctgtcgttgtaattggtcctgatagtttccaccagcttagccaaagcgcctttgccttccgagttaacctgtgtgaaggcgacagtggtgcaggtcttcctgtggactagatggcccagtcttgccttccccttgataatggagtaagggacccccattttacgacacagggcaggcaagaagacaaccacctcaatgggatccatgtcttgtgcaatcaccatcggctgggctttcttgttctccaccaaggtggtgacggtattaactcctgcttgaaagacagatggtttcttagtggggacgtcccctttgccagcagctttcttctcagccagggccaacagcctctgcttcttctcttgctttgtctctggtctgtacttgtgagtagatgtttggtggtccagggcctgggtgaactggttaatcgcagaaggcactttcagctgcttacagaggatggctctctgcctctgcaacctgatgtagcggggccatttcacaaagcgggtgaggtctcttttgggctggatgtcccgtccaatgacaaaattcttaggccttttctcaaacgggggattcaccactttcttggcctcctgcttcttcacgacagcaggggccggagccaccttcttccctttggccttctttcctttcggcatcttgggcggcaggaggagagactattacaataattttatggtacttatttatttgtgtctggaaagacacgggcctctgcttgttctttttttttttttttttttccctaaaatttctccagggtttgcatgtatttaaccctgaagatcacatttacaattaacttctcaggttacagacactgtttgtgcttatgttcatactgcattagatgaaaggttattttgagaacctggatacagtacggtgctttggaactcgtgggagagtacaggggaccggatgggcgcagcgaggttgcagggggcttccactgctgtggttccggcagcaaagcctatttaatgggatccaccacttctctaaggcacctgccctcctcgttagcccgcggccgcagactccaaggccccgggatagctggggtcagagaaatgcagggctctggccagaggggccctcggcagcgcccttcggttcccgtgaggcccaggcagcggttccaggcctcccgctagggccgctctcagactggagggcgcggaggatacagggagccgtttgcctgggttcgcgctcggctgtcctagctcacggggcgacctcggaaacgtccagcgtctgccctgtccccctgcgccgcgtctgagcagccagccccgggccaaagggtcgcgttggttggggcgtggggcagctggagggctgcaggtccccagcgccgcctcccgggcaaggggcggaggcgcggatcgctgaagtcagcccgcccctggttccgcgccctggagcccgagtgcgtcccagggcccgccgcacactgcgctggcccgcggccagtcccccagcctgcggctccaagatgcgcttaacgccgtctctcataccccagaaccctccttagaaacaggcttaccctgccacccattccccatccccccacacacccctgcagggccagcctcaggggtgcatggatttattccgcaggtgcagcaggaacagaggtcaaaaagctgacatcctggaaggatgccttcctatgtcaggaacactgttacctaagcccagctttccaatagttttatcatcatggcatacagaaaccatgatagtctatgtaaaacacactacggctaagctgatgaggctttgcagagggccagggagcacaggcccagggtcttcagctacttccagccatgcccagttccaggagggctaaggaactcaatttctgagctcctgagcccacttgggaaagctcttgcctggactcagtgtctcttcaccccacctgatcacatgcctctccgcagtcaggcacgtgatgcccagccccactcccactcctggaaacctctatctttgtgtcatcaacaggtaccggactgaggagggaaccctgccctttcatggactcagaggtgcccaaggctcacacccaggcccctggatcccagcctcttgtggcactaaccagaggcaggggcaggaaaatccatgacagagagaaatgcagttcagttttcttccacgaggttgaaaacaaaatactcagagatccccaggcctggactctttctcacgggaaaatatcacctctgtgcaacaagtctaaagttcagaaacctgaacccaaggaaactgtagttcagggctgggctgctgggcagaggggtcggaagctccaattttgctttttaattagtcctgggatttgcgggggagggtgctgtacttaaaaaacctttatgtgtttgggctccgggttctgtaaagtcaaataatatttttgtttggggtcccctttgctctaatttgggcttttccactcagtgtggtctgagctgctgcagagcgcggcagtggctgtgccgagtggaggaaccacgctgcagaggggagctggggagggtgggagactccaaccctcagagcaggggccagatccctgaccaacccacaccccgaatctcactgcaggcatcttgagaaaataaacctcaaaaaggtccaattttgatgcacaattatgtttctggagacacttccaggtcatggattaccacagtcaatgaaaacatcctcacactttcccccagtaactaagtgggctacaatataaataataaaaacccagcctgttgattagttagccatttttagaagacagagcaaaaaccagaaatccttatcaaagactggtgctgcgttaagccagcaattctgttcgttatggccaaacggggtccccatctctgttttcacagcctatggaaaaggggaaattccaaaaaatacacggcctcatattgtgtctgtatggaagcaacaaactatttttcctttgtgctcacatcacaaaaatcagtacagaagacttctgtgaccaaaatgtgtggaggtttctccccatcaataagcaagcaatcagttccgcagcagacaccagctggaacctccaatttaattccgacactacccaactggagatggcatcagatcccacagtctgaggactcagtcctcaagacagcccccatttccgatgccaatgggaagccaccggctattttacctctgcttctgaccaacccatgctaaatcaggttcccataccccttctttggattccattaatttgctagcacagctcacagaattcaaggaaacactttgcttacatttactcatttactatgagggatattacaagggatacctatgaagagatgcacaagctgaggcttttgggaaaggaaggttgcggagcttccatgccctccgacgccaccctccaggaaccgccacgtgttcagctctccggaaactatttgaaccctgttcttttgggttttttggaaaccacgattgattaaaccactgaacattggtgatcaacttaaccttcagcccctctctcctccccagaggttggtggtggggctgaaaatctcaatcctctaatcctgccttggtctttctggtgaccagccccatcctgaagctacgtaggggctgccaggcaccagtcaactcagttgcatacaaatgacacttattacttaggagattccaaggattttaggagttatgtgccaggaaacagggacaaagaccgaatatatatttcacaatatcaccaaatctcagaaaccaaactaagggggccaagggaagtttgggctcctctgaggtggccttggagggctgttgagcaactccaccatgttctttccagaatataggggcccctaagcctcttggcttctactttggggctttagctgacaacaggaaaagtctctttgtacgtcttcttaataagattcaactgtgtgagccttttatttataatcattgagataaatagcagaagaaatactaatgggttgaaagtggaactagtgtcaacctaaaataatcaaaagggtcagaatttagtatttttgctgagcgccatggcacatgcctttaatcccggcactttgggaggtcgaggcaggtggaccacctgagttcaggagtttgagaccagcctggacaacatggcaaaaccctgtctctaccaaaaatacaaaaaattagctgagtgttgtatgcctgtagtcccagctactcaggaggctcaggtgggagaatcacttgaacctgggaggtggaggctgcagtgagttgagattgcaccactgcagagtgagaccccatctcaaaagcaaaaacaaacaaaaaaaaactaatttttttttgggggggtagagacgaggtcacactatgctgcccaggttgatcccaaactcctggctttgagtgatcctcttgcctcagcattccaaagaactgggattacaggcataagccaccatgcttagccagagtctaatttaaagagagtttattgaatcataaagtttgaggaaacacccagaaacaccaactccaaaggaatggagacagcattccaatgtagggaagttaagttttcctttacagagacagaggcgtttttagcaggattacatttttcatacaaggttgactcatgcttacagcactttgcctggtagtaggcagtgttttttgtcggggaaaggtacattttgcattttttacagaggatgcaatagtcatgttttctctcatctcatctaagcaaagcagaacaatgaagaagaaattatataaccagggtcattaattaagaaggcaggtttttgtccctgatgtcatttaattctctctagtcatcatacagaaccagaaaaataagaaattgaggaaatctataatctgagaaactaatctattatataatctgagaagctaatctataatctgagaagttataaacatatatgactcagatcacagccacatctctctcaaggtttaaagtgtttttggggttccaacaacatttttgtttcattttgttttgttttgagacagagtctcactctgtcgcccaggctggagtgcagtggcgcgatcttggctcactgcaacctccacctctcaggttcaagctattctgctgcctcagcctccagggtagctgggatcacaggcacatgccactaagcctggctaatttttgtaattttggtacagacggggtttcaccatgttggccaggctggtctcaaactcctggcctcaagtgatcaacccaccttggcctcccaaaatgctgggattacaggcgtgagccagcactcctgccccaacagcttttaaattatatttattttcacgttttctccctcctcttttcactaagaactttggaagagagcattgtagatgaactcaatagtttggcttcttttatgctcaggaatttagtcccatgtcattagaaagtctaattcctaggatgtcataggccactgggaagggaggaatggacaaactatgaagctgatggagtattagccaaatttaaagcaacatgaaggaagtgactttgtgacctgagtcaggttacatgagtatttcagttaatatcatctttcaagtggccattattttagcctttctagtcacattgactcaattgtaaagaaatgttattacagcagtgtggacaaaaacagtacaaaacacaaatgattataattctcagaacaaggaacagtttttgtcaccaagttttccaagatccaaaccagctagttagccagttgcttggagaagattttggatctgaaaagtttgttatttgggttttcatattagccattaatttagtgatattgtttgatttatcagggatagagacacagtatttagtttttatgatagctcaggttccccttgggttgcaataagtttgtctaaagctatatagctttgtaatacaggctttttcatgagaataactttatttaatcacaatattcatgtggctattatttaggacattttgtgcatgattggctagggtctctacatgtcaaatgccaccttcaatacccagttgggcagaaagatggcagctaaaggatcataccaatggaatacagaacaaatccaatgaaactataaatgaggacagtttgtggggttgaaagggtatgaactatgtgagctcgtgcccaggcataacccaaagaacactgtcctaaccatctcagggggtatcaccttccagtgaaacagttcatttaggaggctcagccttcttcacatgtgaatccaagagtctatatcttctaattctgcagtgtaagggttagtaaggagtacctgataaggtccataccactttggtttaagtgagttcttttaaaaatgtcatttccaatggatgaaatctcctggttgaagtctgtgatgcttgaaattgtctacctggagctcactgtgaaaagattcattttccaattcataatttttagttaattacataataaggccattgtaatgactaaatatgcctccctttattattaaagacaaacaatttcctagagataattccttatgtaattccttagataataactagtgtttaccaaaaggtgttgaccttagattaagcagaaccagaggaagagcttttggccaaggaattttgaaagcttctgtttattttgccagttaggttttgatcattctgttagtgcatttcacaaacagaaatgactagaaatttttttctttccttccttccttcctttctttcttttttttttttttttttcctgagacaaggactcaccctgtcacccaggctggagttcagtggtgcaatctcagctcactgcagcctttgactcctgggttgaagcgatcttcccacctcagcctcctgagtagctgggactataggcacacaccaccaagcctgtctaatttttgtattttttgcagagatgaggtctcagtatattgcccaggcttgtctcaaactcttgggctcaaacaatcctcccacctcagcctcccaaagtgctgggattacaggcatgagccatcacacccggctggaataattttttctaagataattttattcacttctaaggctgctgtttttcagcatggaaattcttctacccagtgaggaatttccatgcaaattattaccagaatgtgtttgtatccttgtgatggtggcaaccgaatgaaatctaatttccctacctggaaagggccttagggaaaggaaaatttccttgggaactgtgtaatggcttccccaggttacatgttggacaaatgtgacaacaatcatgtacttacgagctatagtcaaagaaggtttccaaatgtattgttttgaagcaactgttttgattaagcagggctccagtgagttaggtcacgtccatgggttaagaatgatgactgtatcagcaggaagcataggcccgtagctcagcccgtaccttacttcatctttgggagagcatgttccccctttactcttccaattttcctgcccagattttggagctctggattgagttaattttctgtcaaattcaggtgcttctttaaaagttaatatagattgcttttcctgtttagatgcatttagagcagctctttttgccacctgatcagctagctgatttccttggctttctggtgtatctgatttggaatggcctggatttgtaattatggccagtgattttggtaataatatagcctctaacaatggtggaatgaggcatccagtttttttgaccagaagatgttaaaaattatctctgtttccatagcattccaaaatcacgggctgctccaaaggcatatctactgtctgtatgaatattagcagttattccttttgccaattagcaagccctgatcaatgcaattaattttgcttgtcaagtcaaggtggtttctggaatgtaagtactttctatttcttcaaagataccataacataacctgcataataagtcctagattcatcctgtaagtaagaattacatgtaaaccaaacatcagtattggtaaggggagccttttgcaggtccatcctaggagagaaaaaagttgatcagttaaggctatgcaatcatggggcatttcatctgaaggtgagggaggagagttgtaggattcagactgttgctcctagagattgcaatataaggtgcagaaagaagaacttcataagaagccagtctattggtattagtactaacagaataatgatgagtgtggtgtgattttcttttttcacaaacccaatgttttaggagtggtgtgaatttaagatgtttccacagagaatggaacagacagtgagcagaattcccatgaccatttattccgttgttctttctaactgagcagtggcatcattgcccttatgcaaggtggcagtcctttagccacagggtccagttgctgactgtagtatcctatgggtctgttttggtctccatgtttttgtgtcagatgacctaaagtgtttttttgattttcatgaacaaatagtgaaaatgatatattataattcaatttcctagagctggggtatctataaggctgttttttgtgattttttttttcttgagacagggtcttgctctgttgctcaggctagaatgcagtggtgcaatcacagctcactgcagcctcaacctcctgggctcaagcaatcctcccacctcagcctcccaagtaggtgggactacagatgtgtgccaccacccctggctaatttttgtatgttttggaaagacaaggtttcaccatgttttctaggttgagaactcttggcctcaggtgatccactcatctcagtttcccaaagtgttgggattacaggcatgagtcaccacacctgatcgttataatgctctttttgatctcttccaatgttaactgatttttcctcagtccactccagggtgccggacttgtcttgttttaaagagtatataaaggttgaatttttagggagaagtttggaactcaattcctacagtatccttctgacccagaaatccctttggttgttttttaagttatgggggtagggaaagccaatatttttttatactgcctggatggatgaaaagaccttcctttgatattaaatgacctaagtatcttatttgtttttctctaaactgaaatctttcttttgaggtctgtgtccctttaagctcattgttgtaaaaagtgcagcccatcatctatagaggctttgcctagcctctgagcagaggagtaaatcatctacatattgtgaaaagtgtgttgggatctcaatgtatccctggagcaggatgtccatgtgtattgtctgttttctcaagtgaaaatgaaaacaaattgactgtctttatccacagaagtactaaagaacacactacataaatctattacagtaaagaacgtgcctttggtaagaatggcatcaacatgtatggaggtttagcactcctggataatgaggaatgactatgttgttaattgttctcagatcctatacaaacttctatcctctaccatttagtttccttacaggaaggattggagtattacatgtacctctttttatatagcctggaactacaggttttattcctattatagcttctacttttaaagggtactggccagatgtgatggctcatgcctgtgatcctaatactttgggaggccaaggcaggtggattgcatgagctcaggagtttgagaccagcctgggcaacatggcgaaaccccatctctacaaaaaatacaaaaatttaactaggcatggtgttgtgcacctggggtcccagctactgaagaagctgaagtggcaggattgcttgagcccaggaggcagaggttccagtgagcacagatcacatcactgcactctagcctgggtgacagagtgacaccctggctcaaaaaaagaacagttcacagttaagttacataaacatctgttaaacttaacaaagtcactcaatccatatatgatgaatttaaaatactttaaaaataaataaatagagggtattgcttaaggtttggaaggtgttttgatggatctatttgaactttgattggggaagccaagatgattattccaatatcagcagaagattttaaccacaattgatcaggtactacctttagcaggttttgtaattttcattactcaataattcagtgtctactatggcaatatagattgcaattaaattagattttgaaaaactttttatgtccagtaactcagttttatcatctaattctaaatacattttccctttttgggagaaagaagtgtattatataattttaagtctttttctataagatggatgggagctgattcaaccaaaaggaaaacataagtcccttgtaagtgacgtagctgaaaagctacaggctgagatttataaaccaatacaggagtatttgtgacacccaccatttgaattttttgtttactccaaggaatgaatcttgtaataaggtgagatttattacagataatgtggctccagtgtcaacaaaagcttgtgttcatactccatttaaaataattatttttcccaaagtagagccagggtcataagcacaaatatttaatttaaatttcctgagaaaaccaatgtcctggtcctggtgagaatcaggaaattcctgaactatgtctttaagttttacctttgaccatgattgagaaactagggtaggttctcccctaccagacactggctgtttgagaaatggagctggaacagtagaagcagaaggaggaggaggtagatctgggcaaggtactaaaggataaagagaaggagaagataataaaggataataaagaataaagagacagaggagctgagggaggaggataaatttcagcagtctttaattcagaattttttaagacaactttttgttctcttgtaaagaaataactttattataacctctttagaagcttccaagcctcattgaaaataactctcccaattattttgttttatcttatagctgactttttctcattgagcacacaattaaattagtttaggcatttcaaaggtactacattttgtccattgcaaatgttaggattttcttgggtcaagtaagaccatttttccaaatattgacaggaggtggtgccataagtattgtacataaatccagctggagtttctaaagatggattctttcttaaagaggactcagttttagatggaagatggaccataatttggattttctttttaagtgaccaaagactcaaagagaaagatgtcttattttttaatttttaaattttatttatatgtttattttgagatgaagtctctctctgtcacccaggctggagtacagttgcgctatctcagctcactgcaacctccgccttccaggttgaaatgattctcctgcctcagcctcccaagtagctgggattacaggtgcccaccactataccttgctaatttttgtatttttagtagaggcagggtttcaccacgatggccaggctagtatcaaactcctcatgttgggctccttccccctcggcatcccaaaatgctggcattacaggcgtgagccaccgtgcccagctgggaaagatgttttggatctggtattctgcttaacagggattactcctcgaggtgtcacccatgagtcacttctactctcttatgtgtttcagtgaaacccagacatttctggaggcttagggccctgggataccaacccttcatgtatgcccaacaggttaatcagatttccctgtatgttcttccttggggtttccctgtaggacccttacacagcagaagctatgacctctgacagtcctgtgtggcctcagttacctaaggtgcctttcagctgggaggaacagtggccgttatttaggactttctcaggtcaagtaaatcacatcctcagacaaagcctttaatgaatttttggtcactcagaaagaaaatctaaatggcaattttaacccagctccaaaacctggtcagtttaaaactgcacatttagcttaagccacaagcattcactttctctttttaaaaagaaactgctttctatttaaccaattttttttgagacagaatctcactctgtcacccaggctggacagtggagtacagtgtgtcagctccctgcaatctccacctactgggttcatgcaattctcgtacctcagcctcccaagtagcagggaccacagacatgcaccatcacgttcagctaatgctttgtatttttagtagagattgggtttcaccatgttggccaagctggtcttcaactcctggcctcaagtgatccaaccgcctcagcctcccaaagtgctgggattacaggtgtgagccactgcacccagccccaaattttgaatgggagaaaagttgcaaactttagcaagcaaaacagacaaaatcttaacctcaaaagaaagtgaaactacaaacttgcaaataacagaatctctagagaaataacaataaagtgactacctcaaagccaaaagttgagcttcagttctagctctgttgagtgtggaattgggttgcttgaataaagtctgaatctcagccagaactaggaagatatgaaacctgagagaagtcttaccagagacccccgccagctctgatgaggtcagacgagtaaaagccactcatgctggtactaaatctccgaatgccagcaaagcaacgaggatcgcacgaggcttgtttcaggtcctatctgcagttgccaaaatgtcaacttaaaataatcaaaaggatcagagtctaatttaaagagagtttattcaaatacaaagtttgaggatggcccactcaggagcatcaactgcgaagagatggaggcagtgttctgaagtagagaaattagggtttcatttatagatgcagagacagagatgtttttagcaggattacaacatttttcatatgaagttggcacatacttccagcaatttgattgatgataggcaatgcatcctttttggaaagggtacatttagcattttgaatataatgggtgtaacagtcatgggttttctgtcatctggtttaggcaaagtaggacaacaaaggggaagttaatctataacaagagtcattaattaagaaggcaggaggcttttgtccctgatataatttaattctctctagtcattgtacagaacaaaaaaataagaaaacaagttaatctataatctgagaaacagaagttggaaccatatgtgactaagatcacattcacatttctcttaaggtttgaagtgggtttttttgggttccaacagcttttaaattatatttattttcacacaagaaagcaggagggatgggaccagaaactgcctttcagtgctatttcatttttaaagaatgtgcttgcatcaagtagatcacaaattaaaaccacaacaaacccagaaactcccttgtcctgacaggagttctcatgcatcaatctcatcatgtggtgactcgcccctgtcccctgctggggacacagagtccttggcgggggcgcatgtctcttcacactcgtgtgaaatcgtaggcttctggtccttggggagaagctgtgaagtttttgctaccagaactaggattctaggaggcttttagatgaccaggaagaggctgagactcctggtggggactcctgctgggaagtttctggaccacagccctcttggtatgaagagagcagaggacaggaccaggctagagcatctgcactctggagctggaaatggggcccagctctgggcctccactctcagtgtcaaatgtaggggcagccccaagcattggaagtcgccctgcaccctggcagctgcttcttgggctctgtctcccatgccgtgctctctgccccaacctcctaggaaggcccagcagcttcccaccaggccttcagcaaagactgctcctgtccctccagtgaaacactgccccaaaagtcacttgcccactcaggctgtgccgtgggggcagctgccacactctggggttccttggtctcccaaggagtccccaccctcacagagtgttggtcagctcttctggctctgaggaattgcagtttacctaaggaaatgggaaggccagagttgcagccaggtgccggggcttaggggtctggatggacaggtgaggcctcaaggaccaggtagttctttcagactcaggctggcttgggggacccaggcagagtgaacaaccaggcctgcagggggccagggacttggtgcagggcagagcctaggaaggagcagctcataaaacccccaggcagttcctggggagagccagaggactctatccccaccgttgctgccctaatcatggctttgaacacccctcatctcattgctcatagctcttaactttttctgtgccaggaacccctttggagtcctgtgcagcctatagagtcctttttagaggtgctcttattttattatatttttaaatctttttattgagacaaggtcttgctctgtcacccaggctaggttgcattggtgcattggcatgatcacgactcactgcagcctcaacctctcaggcttgagcaatcctcccatctcagcctcccaagtagctgagaccacaggcatgtgccactatacccagataattttctgtagagatggggtctcactatgttgcccaggctggtctcgaactcctggcctcaagtaatcttctcacctcagcttctcaaagtgctggaattgcaggcatgtgccactgcacccaaccccagaagtgctctttttttttttttttttttgaactagagttttgctctgttgcccaggctgggggcaatggcgcaatctcggctcactgcaacctctgcctcccaggttccagcaattctcctgcctcagcctccctggtagctgggattacaagcatgcgccaccacacctgccttaatttttgtatttttagtagagacagggtttcaccatgttggctaggctggtcttgaactcctgacctcaggtgatctgcccaccttggcctcccaaggtgctgggattacaagagtgagcctccgcgctgggcctaggagtgcttttaatgcgtaagataaaatacataggattgtaaagtaagccagtgacattaaactgttgttaccaaaatattaaacaataaatttgtaatcaggtaaactatgtgcttcttcatttaatgaaccaaccacagaatctggcggcaggtctacgcaggattgtgattttgatgtagtgatgaacaaaaccaatattgcaagttatctgcagcaactctgctgtcatatagaaggagtgatgattcccaatggtcacaaagccccaggaagactactgtgggggttttgcccttgttcataatggagggaaaacctacatttcagctagaggttactgccctgaattctacccacagaccccaggcctcctggcccctcctatctcatagcttcagctcttatgcctgtctgccctcggcaccaggtgcctggatccttcatcaccactgcttccccacactcttcagaggcttaggtcctggcagaggcctgaatccagcttgggcccccaccctgcaggtcgtagaagaggggagagtttgctccctggcccagccacaaaataacaacaacatccagagcagagatggagctaggagccgggggagctggagcgaatgaggcggaggaatgggaaacacatgtggatccatgtaggtatgtggctgaggctggctatggctttgtgttacactgcatttttaaaaaatcccagtgtttaggctatatcccaggccaactaaatcggagtctctgggggtgggctatcattaataatccaggcggcataacttttttaattcccaggtaatcatctggggggtgtgctgtgcaaacatggaagccccatgggcaccaggatgttgcctgtcctgcctcagcagcccctgtaagattggagcctggattctgggtgaggcataagctgagtactctgcatgccttcttatgaagccactcggaagccctgagaggcaggtattagtatctccattctacgggtgaggaaactgaatcttggagctgtgtggttccttgtcacttcccagttccctgtagcaaatattggcaaggctgggatgcccaccgaggttgacctgatcgtgttgggcctgatgggagatggaatttacactgtttttacagcttggggagtttgcttgcagtgctgacatgtctacagtcacaaattcgaatgcagagttttctttttttctttttttttttttttttgagacagagtctcactctgtcgcccaggctggagtgcagtgacttgatcttggctcactgcaacctctgcctcctgggttcaagcaattctctggcctcagcctcccaagtagctaggactagaggtgccaccaccatgcccggctaatttttgtatttttagtagagacagggttttgccatgttggcaaggctggtctcaaattcctgacctcaggcaatccactcacctcagcctcccaaagtgttgggattacaggcgtgagccaccgcatctggcccaaatgcagggttttcattcagactcttgtggtgccactcatgcactgctgagatcagcgaggggttgtggggcagtcacagaacagacccagagacacatctctatgcctgaatgggtcttcactaagaacatctctgatgtttcctgtagatttccatcctgcttcatttgtcttttacacttctcctctctgcgaggtcagaaattgccttgggctatcgtaaatcaaagtgggtgactctatccctcagacaaatgccccactttgtagggaatgactcagacacttgattatgatcagctataatattttgagaaagaaaagtgcggttccaacaagttaccaaaagggcaggaaagtatataatccatgggtctctgtgcctctctctgtgtaccccaaattagagggctctgtgtgcaaacaaggacatgtcaaaggtgctaaggaaagaatttctttttaaaaatccagtagcaagctctcgatttctgctgggtgtgcccaaagcatgtgaaatacaggaccacccactggctggggtttttttttacatccaaatgcctctctcgggagtagtaaattttcacataaaagtttgttcttttagccttcctcatgttttcctcagccattctgtttcctaattcctctctctcacctgatcccctcaaaagaagcctccagcaaaaggaggaacaggccattctggggcatggctgtgtcacccctctccattctacattaggctcgccttgggtggccatggtgtcttaggcaaaccggagtgtggctcagtgctgtaggagtttaatgaatgcacggcactcagatgggtatgacgttggagccccccagactggactcgctgagatgatacatgcaaacttggcaggccgggcactggggacagccctgagcctccgggatcagcaccccaggccaggagatgtgggtgccatcagcgagaaatcaggtggtagcacaggtactcccgtcaggacaggaaatggcctctccatgctgtgcagactctatccatcatcagccctccttggagccgtggctctgtccctgctggtttcctttggccagtataggctgcacaggggggaacgcagtgggagcactcctgagtgggagtgaggggagggaggagccatggagagcagggtgggccacggggactgacaagacctcagaacattagcagggctactgggtcatttggctggctcccagcgggcaggcccacacttaggaggcgggggtggtgtccccaggccaggggcaggtaaaagggcagagctgcacctggggttctatggtataaggcagcagaaaagtaagagttttccaagtttctgtgtttttaactcctcccctcaagccatagggaagagtgtcccatcccgaaagggttggccagcttccagaggagggagggaggccccaagtgagctcctggccagatgcctacaggactatgcttgctaagacatttaatattcccctggtaacagctcctgggcgtttcctaggagtctctgaataaccagatagcctcttccagccccgggatgaggaaaccaatccccagaagtggacaggatgggcatggcatgggaggggcatagcagtgttgcttgctgggctgggctgggctgggccagagggcagggagccctgtctactctctggacagtcagtgctgtggccagaaatacagaaatgcaggggccaggagcctccagggcacctagcttttctatcagctcttcttgcaaaggctttcagaaaatatctacaggggacaggaataatggggcccataggcccataagtaaagtcagcatccgtcgggggttgtgggcagtggcaggacagctggttgattccagtcccccagagcatggttatgcgtctgccaagggcccactactgaatcgtttctaaatagcatacttcctgtccctgctgccctggcctggacctcgaccctctctgcagccccagggcagctctcgggcctcctgctcttgtggccctgctactcccctgaggatgaggggctagaaagcttttcccacctccagccatgccagcgaggtgtgaagagcaggcggcagtcagtgcggaggtgtgggccagggcgacacgtactactgtgcacactcagccctctgcgtctccctggagcaacgaggggcagagcagaggtgatgggccatagactcctaggccaggctgagcagaagggtggctcaggctgatccagagcctggccaggcagagagccgccaaatgctgcccagccaagagcccctgtgggttacatgggagggctgacctacaggccatgggccggggacacaccatctactggctacggtggcagatgggggtgggtggaaggaaggacatcacgtctgcagtgacagctgtcgtgtgctccatcaaccttgccctgctctgctctctgttgcgggaaacacatctccccagtttccttcccaggcttgtgggtaggcctgaccatggtggggctcctgcagaagatgggaggccagagcgggcagtgagggccccatgcccctgctctgctcaccgcacacctctccagcagccagccatgcctcctcatgagtgccctgctttggtggcacccagctggagaggcccagcccctggaatcacagcagccccttcctcctgtggtccttccagccttggccacagcagtgcgctccactggcgctaatctctggggtgcctcagtgtcccctcagatcggctcttccaccacctgttaccaaccaccgaagtcctcccaagcatctacaccatcacctctcccatttaacatgaggatagacacacctcgtgcgtccacacctgagtcacaggtctgggaagtctgagtttctaacaagctgcaggaggggtgcacatcagcagccagtcctccagccacactttgagaagcaaggaccagggagattttggatttcctgatacaatgtgtcaggtgctctactaggcagtgggtctcaaaggtgaacaaatccgacctgtttgcattccaaggagggagacagacatggtcagatgacaatcactgcaaatgacactatcactatccatagatgctccgagggatggacaggaggaggtgaacagctgggcccttggcagtctgggggaggtggtatttgagttgagacccagagcaggggacaggcgaaggtttcaggagcagtgtgtgagcagaggctgggtgaccagaggagctgtgtgccttcggtggtctgaaaggaggccagcctggtctccaggcacggagttaggcagattcagtggctcctcctctctcagcaagagaagactcacctgaactcagctccccaaggtatcaggcctcctcctcccgcaaggcctaatccagctaatccagcctaatccagcaaggtctccaggtgctggcagctggagctctcagacacctccccaatcagctggcagtcacacccagactgcctggcgcctgagctcggctgcttgtcccacaaacaaggctactctgaagcatgcatggaaaaggggtaggagcaagggcaggtccctggggacactgagtcccatgcagtgacagcagccttgcccatgcacgcatagaggaaatggcgtgcctcttcttgctgagcctcggtgtacgtgcttccccctaaagcccacttcttatccccacataccaggtgatgtagtacctccctccacccgcctcgccacgtttgggctctgtctctgtcttaagagctgtggaagccaccaaagggttaagtgtgggattatgtggaatttgtgtttccacctgcctttagggctgcagcaggaagcaatggctggaagggaggaaccagagcaaagtggggccacggaaggggagatgtggctggctaccttagccccactatcagtgcagaggtccctgggaccatcggcaaacccggcaccaagcactgaggtcagcctgcccccgggaatggcaccgggggaggaggagatgcccaggacagtctccaagggagtgggcaccagccagagttgggactgggaggactctgaggaccccttccacacttttccctgcgttgagattcttggatggcacaggcccatgagaccatcaacaatcccaggtctcaagaggccgggccccaccctgagccaagcttgcagaggaggaggagaagtgctgagggaaggtgagcacagccaggcacccaggaagacaggagccacctggtcggaggggagtgatggaaggtcagggttcccacccatcagaccacagcttccagccaggacagcttgggcagcagtagtcataggagacatctggaggctgaggcttcccacgcggccctcctggctccattggatggcaggctccgggcagacgagctgccaggtgggtgtgggatgcaaaggtttggagcaagagcgccatggggagcctccccagtgggacagaagcacaggagtgagggggttgggccctgaggagatctcagtgtcacccgcaacggctgcagtgcacggcccatggagaaaggacattgtcaggtgagacgtgggcttccaaaggccccaggctgggggttccgagtcctctgatctttccctgaggtgctcctttgaggcctgtggcaccctgggtatgtggattcccgcctcatgtgtccacctgacaagcacttctcccctggactcctgtgcctgctccatcacctgcaccctctcttaattagcaggttggagagtggggtccacattgaatgggacgttgtgttgactcagaattgctcccagctgtgaggaattgttaaacccctacattaaaacgcaagcagctggcattgagcctagggacagaaagaaaagccggcccctcagcctcaccctgcccccagggtggcctctgtgagccaaagccctgaagtggaagagcctcaggaggaaggcagtctgagccatgggctggcagctgcaggaagtacagctcccgctcccagtgaggctgctcccacttctcctgctcaaacctggggctccaggagaactgtttgtaaagactgggggaacttctggaagaggagtgatatctctgtccactccagggctccaacactcccagcactgtgccaggacatggcccccacttaggatgaccgctgcccggtcgggctcccctaaacgcagcctctgtggcaggcctagcccgagcagccctccctggaagccgtgtgttcagcttcccttctctccagctcctgctgcctcctctaagacagggcaaggggcaggcccggggtcccctccacttctgacatccagtcaacttggatcaggcctgcaggcctgggtgagttcctgggactctcccaataaggttttaaaaaatctttatactttaaaaatttctgccgggcccagtggctcacgcctgtaatcctggcactttgggaagccgaggtgggtggatcacctgaggtcaggagttcgagactagcctggccaacatggtgaactcctgcctctgctaaatatacaaaaattagccaggtgtggtggcgagtgcctgtaatcccagctactcgggaggctgaggcaggagaattgcttggacctgggaggcggaagttgcagtgagctgagattgcaccattgcactccaggctgggtgacagagcaagactgtctcaaaaaaaataaaaataaaaaaataaaactttcttatcaaaaaacaagcaaaagccgcctcgtgatctgatctcaccctactgctacatcctccttgtgtctccatctgtgaaagggtgaccagccttggttctatgcagggtgactgtgaaaatgccatggctcatgggggccaaacatggtggtagggcccactgtgacaagggtgaggctgggctgcacaggctcagctgcccacaaacagctctgggggctcttgggatggctgaggctgctcttgatgagctcagggaagaaacacaacagagactggtcaaaggagaggacacagccttctgcccaatgtccaagagcccgagcccaggaatctcccttgaaacacacactctcacacacactctcacacacacacatgctctcactcactcacactcacacacactcacatgcacacacactcacacattgacaccactgtcagctcagaaatctcccttgaaacacacacactcacacacatacacattcacaccaccatcatcccagaaatctcccttgaaacacatacacactcacacacacacacactcacacacattcccaacaccatcccagaaatcttccttgaaacacacacactcacgaaccctcacacacacacacacacacacgcacacattcatgacaccatcccagaaatctcccttgaaacacatacacactcacatacacatttacgccatcatcccagaagtctcctttgaaacacacactttcacacactcacacacacacactcacacacactcacattcacaccaccatcatccagaaatctcccttgaaacacacacactcacacacacattcatgccaccatcattccagaagtctcccttgaaacacacacacacacacacacacactcacacatacacattcacgccaccatcatcagaccttcgtagatagacacccagagaccttggtctgagtgagctggcggcatggagcgactgagcatgtgcagctcccacatcgctatataaagatggggatgaactctgtggctgtgagtcaccataactgcgacactcactcatttgcgcttcaccagacacagagcaaccgccagccccaagagcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagtaagcctgggcgagcatgtgcatgcacagagccttccctgaccccttcctggtcccctcctggccacacacaggggctttgacagggagatagaaaaggtctgaactctgctgtggggccttgagccattactggacctctctgagcccgcccctgataaacaggctgatagaggagggtgcaggcaatgtccttcctcatggagagcattcaaggaacagaaatgccagccctgaggacaaggggctggaatggccagacctgtccttggctgcactcattcctttcagaggttgctcggatgccccatggagccctccagggaggagggcacaccctgggcctctggatctgccaagcccacagtgaagccttgggtgccttctgccacctccatcatcctagcccaggcccagggccatattccatcaacaccactgctacctggggaaggccgagggcaccctcaggacctggggatgctggcccaggtgctggacaggatgggaaggctccggtagctataggggccactgcggcaggacagagaccaagccaccctctcttccccagaaaggggttagggtgggaggagtctttaaatccctttgtcctgacctgatatggtcatgacctcccttcagtgaccctgggaggcctaagctttctttctaaagggaattcccttcattttcatgccaggcatcaaggttagctgtacccagctatgctattgggcaatgcagcttctcctctaaggctcagtaggggacgggactcttgagaggggctccacccgactcaccaccccagcgtctagaggcctcaaaaactgtcttgggcccttgggctggagtccatactgcaggcagggatgcacccaggagttggctctgtcttctccctaaggaaagatagggtgaccagggccatgtccctgcttgccagtcacatgtctgtctgtcctaccagcctccagcaggtgatctgagcccactcctagaaggcccctgtgccatgttctaggagcttgggctggactttagaaaggacctgcacttcccttctgcttttggccacttgtgagctgtgtgtgcaactggctttgccactctgagcctcagttttcccacctgccctgttgagaatcctaactcttccttctcaggactatttgaaggtgacaagcgataacatgattccctcgtttctctgtctctccgcaggcacctgggacttgggctgctgcctgggtccccctccccacggttgatgttccagaccatgcccactataccctgggcacagtgatcttgctggtgggactcacggggatgctgggcaacctgacggtcatctataccttctgcaggtgcctggttggtggtgctgggcccagggcactgagggtggcagccatgcagacagggaagaaaatgcaggcaggaatgttgactctagctctggccagggcactgttgaggctaggcaaggagggcagggccatgccttcgatgatctcaggcccagaccttcctgaaggtcacggaaagggccaaaaatggtccagggagacttgactgactggcactaattgagacccaggtgcatcctctgtggagggtgtgtgtgcccagagtatgtgggtctctgaccattctgccctgctctcagcgcacctctccgtcacctgccccagagagcatcctccccctgcgttgaagagcagctctaggccaggcgtggtggctcccgcctgtaatcccagcactttgggaggccaaggcgagcagatcacctgagatcagggttcgagaccagcctggccaatgtggtgaaacccccgtctctactaaaaatacaaaaattagccaggtgtggtggtgtgtgcctataatccaagctgcttgggaggctgaggcaggaaaatcgcctaaacctgggaggcggagtttgcagtgaaccgagatcatgccactgcactctagcctgggcaacagaacaagactccatctcaaaaaaaaaaaaaaaaaaaaaagagcagccctggggaccagcatcctcaagtccctcaaacacccctgacacccacccccagtgtccctctccatctgcccccctgcctggctcagtggctgagacaggcaggtggagaagggaacccaggctgcagggccacacagccccctggctctcccacctgccagctgaaggactgggcacgtcatttctcctccttgagctcacttttctttccgcaaaacagagctgtgcttcgtggagtcactgtgatgatgcagtaagttcacggatgtgcgttgccccacagatgagccacttactgagtgctgtgcaccggagcaagtcacttcatgagtgggagcatcttgtctggaaaatggggacaatgacgcctccctcagggtagatgcaaagatggatgatgacaggagccgaggctggtgaaagtgcctggcccggccgtggtgcacagccatcagctcctctgcccttggccatccccaagcatgaggattacagagacagtgtgcagggcagggtccaggcaggacgtgacactggagggagagtgggagggggacccgcggaggagggaagcgtgagaagccatgggaaagcacagtcagggcacgcaggaggaggaacctagggagaaacctctagggagaccttggcctagagggactcaaggaaaccagtgaattggtcaaggaaatggtgtgagtcgtgcagaggaatttagagggcaagaagaggaaacggacatgacccaagaaccggcctgcgctgggccacgcctcaggttttggagagaaactgccccctgcttctctctgagggagccgtcttggggtcctcactcagcagacactgctgggttcaacagctgcttggctggtccctgcccgacagtgggatagctctgtggcccggcagctcgtgcctgtttgcttgcccatgtgtgtgtgcatgtgtaagtgtgtggcacgtgtgtgcacatgcatacctgaggggtgcgggaagctctccatagctctggaggtgtcaggaagcgcctcctaacagcttctgatcctcccaggagcagaagcctccggacacctgccaacatgttcattatcaacctcgcggtcagcgacttcctcatgtccttcacccaggcccctgtcttcttcaccagtagcctctataagcagtggctctttggggagacaggtagatgctggggctcccttttgctggagggaggaggagggttttgacctggggatgccctcaatggagggtggcccaaaggaggtgatttgctgcttctgggcagagagtgggtagctgccctcagtcctgtgagtaagcaagaagggaagatgcagtgttggtcctaaggcctctgccagccttggccagatgtggcaggtggagggggtggagtgcgctcagtcctgctcttcctgtgaggtgaaggccagagcagagtctaccctgtccccagaccctcctccccaggactcagagcaggggctgtgcccacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagtaagtgggctgctggaactggaaggggggcagatgggctgggaggggcacattcaaggggaagtaggtggacttgggtcagccagctggcgggagcagggtgcccaggagctacctgagcctcaggtgagatggacattcaggggacatgactggcagcaagggaaactgacactgccccatcaggggccaaaggatctcctgggcaactgatcccaaaatacaaaggctttctgggcggggcaaagtgacaggtacttctgatgctgtgtcagactaggcagggggctggggtgtgaggactctgaaggtggaacggtggagagcaaggtagtagccctcctggggtaagaccaggcctctggctgaagccctggcaagcaaaaccttgaagttatggtgagctttctgctcaaatctagcaggaatgggaggcagtgggctttgcaggccatcccagttccctccagcttcctcactgcatgggacagggccaggtcagggccagggctgtgtatggggacccgaatgccacatacaaagctcctgccagataaggagccgtggtcagtgccgccccaaaggctgagcacctgccctggctcccaggcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacggtaagagccgagcatggaggggggctacaggagggggaccggcccctcggccaggcggcccctgccccaccactcacacctgcaccagcctaccagagcatgaccagtgggtgaaggcaagctgagcaagtgcttatggggcagcagtgtctaggggagcctcaggagacaagggcttctggggcgggcttttcggcatggcagagggaggagagaaggcacacagaatcaagagggagtagggggcagctgagacctcatgtcacagaaaactttctggaagtcagggctgcctgcactggaaggaatgacactctcacgagtgccctgcaaggatagtccagagaggctccccaacagcagccgtgaccctggtgctgactgccacccgactagggtcagacctggacgatgcgtccttcctagggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtaagcagtggctaaagggttggggaagaggctgaaggtgtgggggcaggagcaagaagcctggccagcctctccttcccagcccaaccccggccagccatcctcgcaccctaggaccagcttcacagcttattctctccctgggtaaggtgcccagccccggggtgggtggggggccacctagttcctggaagcaccagggcacatgcagaggagctctgggccccacaaagctttgggcggacggcctgccagccccctttggaacacacagttcctcttgaggtctcctccctctctgcatgggctgtggttacatgaccagaggtgctgcccatctccaggaatgggtccctgagagctgcccttctagccctttgtggctagagtctggggattgtgacatctgcagcagcacagatgcatgctcaacttcagaagtgtttttgagaagtgagggctattaaaccctggaagtgtttagataggagaccttcttgtggaggaatggcctggtccccccagggccctactgtggggtttctctacaatagccagggcaagagagggcatcacggttggggtggggtgtgagaagagctaggcagagggtgcaagggccagagtcaatggggggaagtgggatatcgccagcagcacaggctccaaggaacagtggacctgggaacctccaccccaaattcggcacatcttccttccagagctgcaccctcaaccacccactgctccctcctactcactcagatcagaattctcctggcataggccaggcatggtggctcacgcctgtaatcccagcactttgggaggccaaggcaagtggattacctgaggtcaggagttcgagattagcctggccaaaatggtgaaaccccgtctctactaaaaatacaaaaattagccaggtgtggtgacgggcacctgtagtcccagctactccggaggctgaggcagaagaattgcttgaattcaggaagcagaggttgcagtgagctgagatcacaccactgccactccagcatgggcgacagagcaaaaaaaaaaaaattatcctggcactgccaattcctccctatggggctgacttagctgtgctggtttgggctggattaggatttgggctttggcagggcctggcccagaagagaaggtgtgtcaggagggccagctagcttggggaccacaccttctctgtcctaggtacgcacacgtcctgacaccctacatgagctcggtgccagccgtcatcgccaaggcctctgcaatccacaaccccatcatttacgccatcacccaccccaagtacaggtgtggctcttttccagaaccccacaccttggcctccaagggcctggcctgccgatgggggcagaggccaccacctttctgtctctcgtgtgtgtgtagaatgggggccaccagcagctgggagcggccaatgacactgagtggggtctggagttggtgtgcctccctcccccgccccagcttcccaggggtcacggtgtggagggaggtcagggttccctgggcagtgtccagtcctaactatgggaccttcagacctggcgtgtagggcagccaggacagccctgtgaatttaagcacccccccgccccgccctccccgacagtgtcatcctgaagaaatcacagcagggagagctcagctctgctcccagggcctggcaggagcctggggtggctctgggccagtatgcatgctgatagcaacccggcaaggctgcttctcccttagtgcttccttttgcctggtgatgtcagtcactcaccaccttcccaaggccagtggcaggcctgagcccgtccagcacagaggctgctccagagtgtccctggtctccattaccagagatgtggcttgagccagccactgagggctggaaccaacatccccaggctctccctgcatgcctaccacccagaatctctctgtccctcccaccagccttgtgagcctctcaatctccccacccagcatctgtctttctgtcctcatcacctgccatggttcccagggtctgagcctccccatttccccagaggctctcggtcaccgcacattaggcctgtaccagcctgtgcacccatcccctcccctgcatctgtctgcccatcccctggccctaatcagatgtgcggcccctgcagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtggtaaggatgctgggccctcaccagcttgcgcctggccatcccttcctcaggcagccctggggctctggggaatacataggccctggcagggctgcctctgagactcagggacactgaggacgctggcaccctggcaggaagagcccctcccaacacccccatgaagttcgtaatcctccctgataggcaggggcactagggccagagcggggatggtttgggggttcccaggagcggggccaggattgaacacaggtcttccaactccaggccatccttttccatgctgacactctccctagagccgcagcctgaagagatcagcacatctggctctagatagggctccagagagacaaggcaggagttagcttggagctccttgctcctcagcattaagccccctcctcctgggagacttgaagagctcacgggatgggcatgggccctggagatgggagatgtggctttgagcctcagcttaccatgtgctcactgtgggagcctgggcaggtcacttactccctctgaggctccacgtcctcctctgaaagggaaaagaggcttctcagatcaacgctgtccaggtgtgcccagggatgggtgtcaaccttcctcggggccaggtgtgcccagggatgggtgtcagccctcctcagggcctgcagctctgcttcccctagatgtccccaggaaagctccgtgcgccaccggctcctgttcccaccacacttgggctcctccttaattctacctacagagccctctatgggcctcagcaagactgccgccaactgaccggccagcgatctcctcccactgcccacatccctggggttctcggttgagggactgagagaggagctgtcagaggtccctcctgtaaaccactgtagtgaataacaaggagaaatctaatctgttattggaggcctagaccctcgtgaagaccacccatctattcaaaaatataaatagccactttcttagcaaggtgtgccggtgtgcagatggggagcaaacctgcacacacatacacacaccctaggacaggcatgcacaatttacggggtttatttggtgaccggcaacggtgcaaatggtgtcaggggcctcccgcaatgaatacctgttgggaggatgaaggagggcctggtggggtaagggcaggagcaaagctacggactgtccctctcacctcacagtcactctctcacctccctcagggctggacacacatggaggcagcagctgtgtggggagctgcccagcaagcaaatgggcggtccctctacggtcagggtctggaggacttggaagccaaggcaccccccagaccccagggacacgaagcagagactccagggaaggtgactgggcccggtacctgccaatccacaaaggggtgggggttaggggccagtagcccagggagaggccaggaaagagagacttgttctcatgggcaggggcgatatcctccaggaatcacctgctcccagcacctcccagcttttccttgtctgcctggggttctctgtgactctgagatgctctgagcagggcctgcatatggtctgcacatgtgtgtgtgtgtgtgtgatcatgcaactctgactctgcatggtgctgttggctgtgctgtggcatgataagagtacatgtgtgtgttgatgagggtaggaggtctgcagccgtcagagcatagctcgagcatgtgtgtggccatgtgcccagcacatgctccatcactgtagcacctggcacatgctctgtcactgtaacacccagtgacacgtgactaagcatgccctaatgtgtctgctttaagctgtgcatgtgactgagtgtgggtggtatgtacctctctgtgtgactgcgaggttggacatacctggggaggaaggggctgtaagctgtggatgtgctcaccataaatgccctaagatcaggatgtcacccggaatacttgtggctattaaaagaaggccagctgtcggcccaagtgcctatggaacggaatgttgatggcgattagagaaggccatattctggaacactggaaatgtcgtgtgcacaggctcccaagcagcccttcgccccagctgacagctccccatctgcccctcctgtcacacccacacaacaccctcagctcagctcctgggctctctccagcttccctagctagtccaaggccaaaggcacattcctgcctgcctttcttcctgagtgctgtgcccctgtgcatccaagaacgaaagccctgggctgtacctgcagtcggggagcctcagcctccctcagcattccccccgggggccccgcaccctgtcctggagcccaggcactgtgcatgccataaacgccaggacaaaggcctggcagtgacccccaggctggccaggcactgatgaaagacacagtgcctgtcttggagggataggctcaggggggttgctgggcagccatcaacaatcaccaaacacatgtgataagcgctgccattgaggtgtgagcacgcagggtactgaaagcagaggcaagtccctgaggttccccaggaagatagaggtgaagcagggatctgcaggcagcaggggtggggagtggggggagcactgagctgtccaggatgaggatacagcctgtgtgactgtgcaaacacaggggcacaggggagggagctcaatatgtcctggaacaggatgtctctctgtgaccctgggagcagccagagggaccctggggattggcagtgggggacataggagaagggaagaggaggcggaggtggtaggagcagtgggaaggccccatcagggactggcttaggtgtctccagacctgacctggggacaggaagccctgggagggggttggttagctttgcagggtgaagaccaaagaaggaagtgctgcagggcaggaaagggatgacccatttaaggacagcaggagcgggggtgatgccagagtctccacatgtggaagagaggagcggattggatggtgggggtgaggatgggttcagttgtgaccccgggagtcaagagcccggggagcatcccaggagatgctctgtaggcagcgttaggcgttaccagctcttactctgggatgtggactctgggaaggcccatccctgacccaggacacaacctggcccttccatgcaacctcccccactgctcggtgacccagtgtgtggagggtcatcgggagactgcccccagtgaactgctcctcagctaaacagatgtgtgctgtttgtttgcagaccaaggggctgatccccagccaggaccccaggatgtaggacgcccactggctctccctttcttctgagacacatccagcccccccacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtatgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcagacaaatatggtctctacgtgttggtgctgctatgggagagagaaccagggcctggcctctgatgcctccagcaacttcacttcctctccttcctctgtccccactcttgggactctcactctgaggcccacctcaaactgcaaggagtacagcagagaagggacaaaggccaggctggcctccatccccactcactccccagtgagccattgaactccgcccagaccatgggtaccagctgctctctgactggcttcacatctcccgagggaggcggatggagggaggccggccttcgcctttaagagcactctcctgccacccctccctttccccagaggcgagcttcatcaggcaggagccagaggccagagagacagcgtgcagctccaggtacagcctcccccagctccctggccctgagggtgggtgccttccttctcccacactggttatgccctgctgctgagtcctccccagcctggcaggatggacaaacacccctaggaaagggcataaggctggagttagggatgaatgacatggggctttgcagagagggatagggaatggtatggggaagggatgctggccatggactgctggcctcctgggctgggctgcatgatatagggtgaaggaagtgattaagcagggaaaaggacacaggtcttttcctgacttcttccacttgatagttttgtgactttgggcaagtgacaaaacaaccccgtaatatgggtgatcctaccttgtaccttgcatgtgccaggccccaggagtgaggctagaagctgagaaatgactcacacccaggcctctactgactcctcagggtccaagccagacccctccaagagggccagcaagcagccaacccagttgcctcccctgagcctcagtttctccaaccaaggagccagggtgggccttgatctatctccagaccacataggggcctgaggtctttcttggggaaggggttggcccaaagaccgcactggcagaagtcccaaggtgctgaggcccccatccagaacacactgtctctggggtacaggctgaacatgccacacgtgcttccccctccctgcccctcctggccctgtgtctagcagctgagcaaatggcgtctcctcccttctccctgccccctgccattcctgcgcaaagggcacggggcctggcgtgtggcactggcagctggagctttccatgctgccgtcaagttttccagagcacaaagacaggagagccaggaataactggctgggcccccagagggtctggaggggatgggcctgcctcagacctgctttcagaccctatgccaaggggtgcaggcagagggccagctgcccaggaccagggctttgggaggcttctgtggctactgggagcccattatctggcatgcattctgtaggaatcagcccaggctccagtgtgacctgggtccactccttgtgtgaccttggagaagtcatttaacctccctgagctttgtctcctgcgggcccaggtggcagcttctcaggatcccagggagtgaagggcccatactgaggttggctatgcccagagctgctgttatgatgatcgtttttatggctggacaaccctgggccagtcacagaccagctggaggctcagctcaagccaaggcacctccagggccccatactggataaagcacaaccccagaatcctggccagggaccacacggcagcaaagcccctacccaagggagctcagcccctggtcttctgagcaagaggatgggtaccactgggcaggaagagcgagtgtctacgctctccagaggacacaggagcaaggagaccagagcattctcaccaaccaggccagttccccttcctcccccctggggggtgctgggtgccggacacccctccccaggggctatattagccgtgtgagtcatggtggaccggctgggaggcggcaggctggcaggcacagtgtagggttacagtccatttatgggcgcagccgaaggcagatatcagtgtcgatggcattcgctcccagctattcttaggagcctctcaagagctccacgcagcccggctgggcagcaagggacagaacaggcaaggctgggggtcaggggcaggggcagaggtgtggaccgggcaggcggagtgcctgagtgccctctcactcaaccctctctaccctttgtctgcagaggcggccgctgacagcaccagcatgtcttacagtgtgaccctgactgggcccgggccctggggcttccgtctgcaggggggcaaggacttcaacatgcccctcactatctcccgggtgagtgcaccctgccacagcctggcacccgatggggcaggcacgcttggaggagggcatgtgtgtccgtctgtctgtctgtcctttctgagcctctcagaaagcagagcatgccccatcccctgggactggcctggtcctctggtctcagccacagctgtttgctcactggagcgcgccggcctgttatgcatgtgagacatcatgagcaggtggtaggtgtttttagcagagaagaaaatgctgagttttcaggcaggcaggcaggcaggcaggcaggtagctggacagagagtacagcaccttcctgatccctttactgttagagtgggctcagggtgcccccaagccttgagcatttccctagatatgggcagctgctttgggaagggagtattcccagcatggagagggcaggtgatgggcagttggatagatggacagacagacggttgaccttggctgcccagctgtcagagtgtggggctgggctggactgagtactgggcacctgctccatcccaaacttgagacaccaagaccctggctcatggggctgggcgcttctccccattcaccatggctgctttgtctgtctcaggtcttgttccccacaagtgctggggcctggtgagatggccccctatcctgcagtgtctgtgatggggagcagcatggcctgatgcagatgacacagaacatcaggggttgtctgagtaactctaccgcctggctggagacagcaacaccagagaggcagaaagttagccatgctcctgaggaagcactccaggagcagggactgatgggggaacagcccccagaccgtagtaggcactccgtcagtttctgtcaaacaaagagactccccagcaaggcactggtagacccagggctgaaggccccaaggctcagggcgaactgtgaggcatacagggcaaggacaaccctgcctggtggctgagcccctgaccgtgctgttccgggcacaaggccagagggggaggcccccagtctgtcactggagggtggtaggtaggcaggggtatctgggctactgcccaccaggggaacaaggggacagtttcttctctggggccttaaggacttgccttgggcctgggggctggaggaaggggttggaggggaagcactgaagtgggcaaggcctgaaggggcttggcagaggggccagggaacctgggcagcgggtcaggagccaatgcccccagtggaggagtaatcttttttttgttccacgggtacttgaggggaccccagaagtagaagccccacccagggatgccgtgagagccttataatagccatagaggccacatgcttacaggaggggtgctggcctggctctggtgcagggaacaggccctgacctccatccttcagttgcagatgtggcttgttctaacctggagattccacccctccagatctactgccctggagaccacagggtcctgggcacccacagccttgcacactttgcatgaggtggtgacctgtgagcatgtgagccccagtggatttcccactgccctttcccacagctccccacccccatgcttgcaggactccttcctgtataaggtggagcctctgtgtgctctctcatgggccctgtggcctcccctgcctgggactgagcccacatctcccccagctccaccatctcgaggcctcctgctggtgctccctgccctatccctatgggtgcaaattggccactgggctcagtggcactcaggatagccaatgacctcacccagggtctatgtgccacctggccccggccagccaggggcttaaatggcagcccagaagccttaagctagatagcaggaggaatgtccttactctggggagggggtatgcagggatgtgctggatccaatgactgtggggacttctaaaaatagaacccgaagctcgggcagggcaccgggggatgggcatgatatggcctctcggcttcctttaggggcataccccaaatcacctaagccgcggagcaggctggactgggtactggagccttccccagggctcggagcctcttgagaaattttggtggtaggctgctgatagcctgggcttgtgtcctggttcagtgccgctggcagggcaggccttgtggacacagccctgccatcccaccagggctgtaggatttactgccggggctcgcagggcccttctgcaccagggacatccccctacgggggaggcatggccagagctctctggaggaaccccactcccaccccagccaggacctgagcctgtgccatagggcaccagaggcaagagtgtgtgaccctgtggggtgggcaggcaggcgaggctgggatcgttacctcgcttcagagcctggcaaactgaggctcgagtctgctcacaggacagggatgtccatgggtggatctcctgtatcctgtcacccctaactcccatgctggcttgctcacccctctaactgggactaatagagaggcactggggagggtctgtcccctctcagctgcaggtgtgtgctgcagctcctcctggaaggacacaggccacctgcaggctgggtggtggctcccgggggctcatggcagcaactttggggcagcagcagcccctcaaggcatcccttcatagggtctctgcttgcagacccacagagaagggagttcaagagggagactgggaaaggagggtggcggggaaatgcctttatttatcctggacaggtgtggctgggcctgcaacatgagctgccctttcaccccaccccagccagttctccaggaagtggagaagggggagcagcccagagagggagcagctccaaaggcctctgccctggcagctggccagaggctggggctgtggtctggggtctcacctcttcatgcctctcatgcctccgccttggggaagaggagtatgctttgttaggctctgctgctctcagctgtgtcacctcagaagtctgtttacctgctcggcctcagtttttctcacccttaaaatggggatagcaggctgggcgcggtgcctcatgcctgtaatcccagcactttgggaggccgagggggcagaccacttgaggtcaggagtttgagaccagcctggccaacatggtgaaaccctgtctccactaaaaatacaaaaattagccaggtgtggtggtacatgcttgtgatcccagctactcaagaggctgaggcaggagaacagcttgaacccaggaggcagaggttgcagtgagctgagatcgcaccactgcactccattctgggggcagagtgagactccatcttaaaaataaataaataaataaacaaataaaatgatgccttccacacctgtgagagctctttctaacaggcacttgtgaaaactttccacctgttgtctactgggactggttgtgagactggtggagtcgggggctgagcctgggcccaggaggggcctgcctgtctactggaaaccctctcttcctagggtctcagccaccccgcctgcaggctcacctggagcaccagctcagaggcctcttctctgtgggtttcggttccagtatttatcagactctcccagctgtggtgggaacatgctgaggacagagggtctctggggagaggaagggggacaggctgagactattctggggtagctgtgccggcaattcctggaatttcggggccgctggagcacgcagtgctgtttcttgggcagctcttagcagtgctgacaggccgtgctgtttatagccgcactgaaggtcaggcaagcctccgagggcttcagtggggctggcaggggcctccctgcaacatctatcaacaggggaagataaacggccagaggctcagaggctcacagctggggaatgcattcttagaggtcccccaggccaggtcctccgggctgctcagaactgcatctaactctgtgagggatccaaaaggagaggacatgaggctggctgggtcctggggaatgaattggacccttggaggcccctgggccaggacaccgtgcaagggcagctgcataagcagccccagggctccgggcctacagatattgtggggtagccagtgtcaggactgcagggctgtttgagaaaggctgggccaggctctgctgggggctagctccccaattccctgagtctccttccctttctgcatggtcccctctcatccagaggctgcccctgactgcaaagaccctcctctacactgagccctcccacccccaaacacagctttggcacccctttgggaccaggctccacctctgcccaggaaccatccttggacacaagaatgggccttgctgggggcccttgagagccagtgcccatgagggcattttattggccacacccaagacccaaatggaactgtggacctggacaggaggaagagaggcaggagagactcaagagacacttgaggaaagccaggggaggtgtggtcagctacagagggggcagtgacccgtggctttggacacagaaggtcattgatatgcgtggaataatggggccaaaggcagacggctgtgtgtgagcaggtgggaggcagcggcagtgggggcaggatgtgtgggtcacttcttggaggagtctggaggtgcagaaaggagacatgacaggagccagttggagccacccaggcaggcagggagaggctttttgagcattgaggggactccggcttatttatcggccagggtggagttggggagtgggaccatggggagacagaaggttccagtgagagggtgagcatgagcaaagccccaggggaggccagatgggaaggcagcagagcaggacaagacagtaatttaatcatacaatgaaaatgcactttgtcccacctgccccaacccaggcaggcagcctgggagtgtggggagggggagctgctgaaacttgtacccttcctacttatctgccacctgccccagcctccacccaccacatctacactggcacatctagaagaggaggaaggcaggggcctgcctggtttgaacaccgggagtgaatgatggccagaaacgtctgcagagcccagctgctctctctgctgccagggaactgggaaaataggagccaatggcatgggtgcgtctgaagcctcactggtgccttctttcccctgggccttggacagaagtttcctcccctccccccaacacccaggcccctctagggacagcaggctggctcagaactggtcagtcagggctggctcctcaagctccaccctctgccagctgtggatcttgtttcctgtggagcccggggatgtagccagccagcctcacaccttctgggggtagcagatggggtcagcactgtgcctcctggatttggagttttcctgaaactctctcagctctgcaccctccttacataatcccctgtttaacgacataatcctcacaacaatcccgagaaaggcattgtcattctcttgacactggagggcttggaggctggcaccgaagtcaggggcccggcccatactggcacctgtgctcctcctttgctgcctccccgcccccagcccccagcactcacaagtggctctggcaccagctctccctgggctgcccttggaagtgccctaagaccttggcccagcaaggcggaagggctcctgggggcagggagctgatcttggcctccaaacacctgcagcctttcttgggggctttggagacaggagctcggtgccccaccctgaggccattctaggctgcacccagggttgggtttccagggtttagaggggcccattggcgggagaagactgaaatgtgaagtgggaatgaaacactcattcaagggaggcatttaaatgctcaaaggcggctagaaagattaaaaagaaaaaaccacagctccaaggagttgggtgctttgggccctttctgaaacacagaaaggaaagaggaggatggagtcagacaagacagacgtggaagcatcgtgcctggactgcactctccatgagccctggactctgggcaagggtctgagggtgcccccctccaacccacccaggcaggctgctcctgaggtggggtgaaggcatccgatggctcctgatcatccatagggtccctgcctccatcctgcctgaagcacctccctagaggaggatatcagcacccccagcccccaccctgagggatgttggaccctactcagggcagccaaaggccaggccagctgagccctgacaagcagacacagctgcaggggagaggcactgggcaggggatccagctcagccacttccctctggtcagaggcttggctactgaccagaccccaggaggctgagctctcccttgggagcaagcatccccccggcccatacctgaggatgagggagagccaggcaggtctaggtgaggggaagtgaggagacctggtggggagggctggtgcccgctgacccatgcctgtgggagaaagatgtctctgaggcagctccagagggaggacagtcagatagccctgcagagggcccctctgatctggccccagcctctcttggatatcattctgttgcccttgctcatgctgtcatcatgatcttctggacacaactcccatctttcctgtcagcatctcctctgtgaccgaggccacagcctttctgcgtggggtctgcaatgacccagccctgcagggggacgaccccttctctgtagatgggcatttgggggtgccctgccgtgagagagccttgctgtgggggtgtcctgctgtgggggagccccatgggcagttcactaggacagaacagacattgcaaaattcgccctggaaagaagtatgctggtacctgcaactttctttgaaatgcccggcaaatgagatggattgatggatgtggagggatggagtgtgataaagcaaagcgagtgaaatgttatggtacagccatggtggcgggtgttcaggtatacactttagaatgttttctacttttcctgcctagaaatctgcaaaaatgtctataataaaatgttggggatcacatagaggagtagggaaagttgattttctgcaggacaggcctggctgggcagctcaacttgcccccaggagtcccctctcagtctagaaaactcttttgctttccttcactgatgttggtttttacactttgttcacctctacactcaaggcagcaatacactcctgtcattaatagaggctatggcaatgagtctgggggtaagggctatgtgtattttaagaaatctcaagtagctctaagatgcccctgcggggcctggagggcaagctggactttgcaaagcagatgctgtggcttcctggcagtccagacgtctgtttctatattgtcctttcctgtctctgcagattccagggcaggggaaggggcgctgtgggcacaaggtggccagtattttaagagggcaccacaggctgggtgtggtggctcatgtctgtaatcccagcactttgggaggctgaggcaggccaatcacttgaggtcaggagttgaagaccagcctggccaacatggtaaaaccccctttctactaaaaatacaaaaattagccgggcatggtggcatgcgcttgtggtctcagctactgtggggagactgaggcagaagaatcgcttgaacccaggaggcggaggttgcagtgagccgagatgatgccattgcactccagcctgggcatcagagcaagaccctgtctcaaaaaaaaaaaaaaagagaaagaaaaaaaaaaaagagggcaccacagcccctagggctgaaatggcaggttcacagcaattggagagggctgtcctggtcttgccgtcatcacccacgtggtgtagggcagtgtttccgtgacccgtaatgtggtcgtgcagaaacaactcagttcctgggctgcatctgcagagcccatctgggaatgggctggacactggtgactggtgactgcagggcatcctggtttggaaggggcttccctgtgaggggactggcaggagcttccacccatgtctgtaagcccagagcctggccagaggcccacccaggcttggcacctggggcaagggactgtccccagagcctctctgggctccttctaggatggttctcgggccttggcctgaatctagcttctgccaacactaggagctggcttggtccttgggttatagccaggaaggtgactgggatgtgcccagagaagcccagaggactggctggtgggcatgtttgggaggcaaagccaaggaacacttccagccacagcttgtagggggtggggtccggagcctcctctttcctgtgatgtccctgaaggccaggcctgcatggcactcctcatgatgtcatgggggttggggacctccaacatggtatggtgggagtcaggtcataaagccattctatgtgatattagcaggggccagcccattccatgtgatgtcacagagggtacagccagagtctctggcattccatgaggtatctttaggggtggggctgctaatgtcactaggggccagccatcaagcctttttaggtgacattattagaacctctgaaattttgcatctcatgtgatattactgtgggcagggccaccaaagcattcagtgtgctattactggaggccgggggtgcagaatttggcatcgtgcatgatgtccccaagagtgcagtctgagccacgatgacatcccaagtaatgtcccaggaggtgtggccttcctgagattccatggggaattcccgggatggagttgcagtggcattctgtgtggttacactgaagatggggcctccagactgtaacattctgtggtattatcggggctcagggtttgggaactggcccccgcacctgcaccctgccttctggaggtatgacatcaactacagaaccctaagccctgccccatttcccagctgagtttgctcatccaggcagggttgtcggctacctcactctctccacatctgccaggtagcacaaagcacctggcactaagatgcttttgagtgggtgcatttatcctgcccttcagcctggcagtgtctctgggatgctgctgtgtcttagctgctgcatctcccttttctcctggagtctgaaaagtgctccatagctttgcagggtgcaggggttataagaggctaatcaaggttacaaatagcctgcagttttttgtttgtttgtttgtttttagacagagtctcgctctcacccaggctggagtgcagtggcataatcttagctcactacaacctccacctcctgggttcaatcaagagttcaagcgattctcctgcttcagcctcccgagtagctgagactacaggcacatgccaccatgtccagctaattttttttgtaattttggtacagacggggtttcaccatgttggccaggctgacctcaggtgatctgcctgcctcagcctcccaaagtgctgggattacaggcatgagccaccacacctggccaccctttttttttttttttttaagaccgagtctccctctgtcacccaggctggagtgcagtggtgcaatctcagctcacggcaacctctgcctcctgggttcaagcaattctcctgcctcagcctcccaagtagctgggactacaggcgcccaccaccaggcatggctaatttttgtatttttagtagagacagggtttcaccatattggccaggctgatctcgaactcctgaccttgtgatccacccaccttggcctcccaaagtgctgggattacaggcgtgagccaccacgcccagcagatgcctgcaaatttttaagagacagagtctccctctgtcacccacgctggagttcagtggtgagcgatcatagtttattgtaacctcaaactcctaggctggagtgaccctctcacctgcctcctgagtagctagaactacagccatgcaccaccacaccctgccaaatatttttatttttgtagaaacagggtctgggctcctttgcctgggctggcctcaaactcctggcctcaagcaattctcctacctcagcctcccaaagtgctgggattataggcatgagccaccatgtccaacagcctccaaaccttaatggctcagaacaacaaaagtttctcattcatgcaacgtccaatacagtgctccttaatcatctctcctcctctccatgccctgcattcagtcagtcaacaagcagagagtgtgcaggatcacaaggatggttgctagaggcagacctggaaggagcatacattgcttccaccctcattcagttggccagagctagtcccaaggctgcagtcagacacaaagctctaagcaatgtggtagtcatgtgccggaaagaggaactaggcttggttagcagctggtactggccgtagcgaatgaaaaacacaatgacggcttctgttgaatactcccgggtgactcttccccaaggactggcctttcctcaggaccaccttccttatgctcaccccccacctccactatccaatcagatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaagtaggtgggagctctccagagcagggggcggaggtttgggtgtgggcatggggcaggggccaaaagagggattgtcccatagcaattgagtgggccccgccctgggctacaaaactgtgcaggaagataaggacagccctgggccagaggaatgaacaggcccaagtcgctgtcaagcacctagaggcagacattactgcctcactttacagttaaggcagagatggtggtcctggtgctgcccgtacgtgggccattggtcctggaaggcaggtcttacctacttccactttgcccaggcagcccccagtgacgtagcaggggcccatggattctgaccaaaatgcccaggggccatgatttctccatcctcgtcgggcccagggccttcttggggagatccagcccatggggtggacagtggatctggggccctctgactcagctatctctgagagctgactctggctctctcttgctctctcctcaccagccctgcccaggcaggagcttctggccccaggggcaacttcctcacctggtctcatttctggtttctacagatcaaagcgtcccattcccatctccacgacagcacctccagtccagacccctctgccggtgatccctcaccagaaggtaggtgctgactgtggcggcggggtccactcagccctggttcctggagtgctggccctggccagcctgcctggtctttggctggcccaactgggatgaggccgtgggatcagccctgccccatccctgcccctgctgcagctgaccctggggaagtgaggcagccccttgggagagactttcaagcccctgttgaacactggatgtgggaatgaatgcctgcctgggtgcaagccacctccgctatgcctcgtggctgggctgataggaagccagcttgggcagcagtgttcccaggagaggggtcaccctcctggccaggcaggggacgagcgtccaggctctgaccttcatttgccaagggggccaccgctgggtgactgtggctgaggcccagcttgacgaggacctccaggtgtggaggggcctgctggcctcacccagatctctccctctggtttccacttccccacctgcccctcccaagtgcattcccctgtagcccttaggacgtgctggcaatggcaggcacaggggagaagggaggccaagccctggctccagacctcaccactgcctaggcccttcccaaggccccgccaagcagctcaacccccgagggctccctgctcaacttctccccctatgtgaactgatagtgaccccacctgtccaatggggcagattgggcagggcagtggggagaggggagaaaaagaggctgacaggggtggggtaggtcacagactggggaagtgggtggagggctgcttgggagatgcttgcagaggtagactgaggggcccaaatgtgagctacccaattcctcagcttccctcctcacctccccaccacctgcccacaaccagcccaggaacttcatctcactggcagtgtggggtcagtggagcaggaggctgggctgtgcccactgggcacccactctcaggggcagggggaacagacacagaacgggccatcccctgacccctacacccacttcctcgggccctgggggcaggaagcttggcttggcttccatgcagggcttggcactctgcccagctggatgccagcctcacgccaggccaggagccatgtgcctgcctgctcctccaccagtgtcctcccctccaagtgctgcgcccaggcgctctgggcttcaggctgcggggctcgcgctaacacatctgtttcaggtccacgcaggagcgctgggacgcgtgtggcctctaaccgctctcttctctctcccctgcatggcctgccctgtgccaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggtaggtaacggacatacagctctccacaggtggcctgggccacctgggtcctcggtgctcggcagagacctggtcaggtggtcagagcgaggcactggccccaatccagccagccccgagcccatgaggtcagcagtgatcctgcggcatttgccatgagccgggcatgctagcgatttatacaaccaaccacgctggggtgacatgtcggattttgcagaggaggaaactgaggctcagagaaggttaagtcacagtccgtttgtccagctaccatgtggccgagccagtcctgaattcaggagattctgacttccaacactttttcactaggccactccccagaacaggacagcacagcctgcagccttcaagagctatgcacaggtccccacccctctgggagctcggaggcaggagcaggggagcgttcgagaggtggaaaagcgagttatctgggactaggaatagtctgggaagctgcctggaggagggagcccttgaattgtatatggagagactctttggcagtggcgtgcagggagcgggtttgcaggagtgaccttggccagggtggggtggcgaggaagcaggaccccaaggagaaaggggctgtgcaggagaacagcagcctcacccctaaggtctagctggcgggactctgggagcacagcaggtaaaaggacatgggactggggcactgtaggggggaggcaaaggaacggagtccccacactgggcctgtgttagctctgagcccttcacgcttgttctctcaccctaacttctactcccgccctgtgcaattggcatagccctctccaggcagggcaggctgagtcaaggcagtagagcctagtggttcagggttcctcctccgaatcatggaggaatcacactgtccatgtctcagggttattgggaggataaagggcccaacacttgtaaagctctgagctttgtctgtcacccactcactgcatgacacctggtatcatcactgcctggagccacccagaagagtcacagtaggaatccggtcagtctggcccaagcccatgcccttgcctttgcccttgcagcagaaggcacctgtgccccatcaggtcactgctccctgtggccctcagcttccccacccccccagctctttctagaatcctcagtgaagctgatttctggcaccacatggcttgcttcccttacccaaggtgacagagccatatatgcccccagggttccccagcaaaggacttttgccagaaaactcagggaatagtagaacagagatgacctccttgtcccgcatttgttgggctggtaggtcttcccggtccttttcaggaactggcctcaggcagagaggtcagcctctggtggcctgggactcccaggagacccacctgcaatgatgataatgtctccccatactgaccatgcactctggctatggaccagctaacagtccacatgccttatctctcagcaacactctctaaaacaactctctctgcaactccagaggtgggcatgattttccccattttatagctggaaaatagacgctcagagagagcaagtaatttgcccaaggtcacacagctagtaagtggcagacagaactggcatgcaggtctgcctgactccactttgcattgagacagggacttgctgcctgctcagggaagtgaggggccaggcccacctctgcttcccatagtgcctaaggtactctgctgtcggtgcaggggctgcccagaccctgatgaatgtgtaaattatttcttggtgctcagagcagcagagtctgacgtttcctccaagggatggtgggctaggggaggatgtgcagtgggtgcttcatccaaagtaaaagctgatgctgctgtctcaggcaatgccggcaggaagggctggagcctctgacctgggctggcctagggcaacctctgctgggctgaggccaccacctatgctaagtgggtcagcaacagggtcagcaagggctaatccccgtgcttatccatggcacacttctcccatgctgagcaccttagactcatgacccgttcagtctgcacaacccacctgcggggtaggcactaccatctcaagaattagaattaggaaacaggctgggacgggtgggtaatttgcccggagtcacagtgctaggaagaggcagggtcacaacttgaactctgtcctgtctggctccaaaaagaagccccttccgctactctctcctctgggcaacttgcagtgcaattctttggcacctcgtatcctcttggaaggaggagagagaaacagatgtggtgcaagggcagacgggcataggcatcccagcagcccccttcttctcctcccttctgaggctggcactgaagggcagtgcccctcaggccactcagtgcaagggcccctgggcaggtcttacatctttggctcatcttccccaagacccaggcactggctcctctcagatgtgtctgctgccaccatcccggccccaggtcctgggtgggagaagctgagcaggaggcaggaataaatgtcaaagaaggagcaggctgccaagggagggcagaggcagcccccaccccgccaggccaacactgccctctgcagggggccctgggctggtcagggcaagagatgaccctgcagctgtcagcactggccaaaaatggagaaggaatggagctccgtgctggccctttcctaatatagctccacttgcagctattttgagcctgggaggatagagggaattttatcagttctgaggcagtggcgggcctggggcagagcagggccactgtgctgctccctgggaccggggaccactgacttgagcctggcttcccagggtttggctgcaaatgaccagggccaggctggccggggcccaagctcccccagctacagcccacactgggcagattcaagaaggtggcagagtttggggacagagccccccaccttccacactgtctccctcacaggcccccgacagggctgctggccacagggtctgccactgcagggaatttgcatttaaagaaacacaggacagacactgctttccctacagagaccatgctctgggaggctcactctcaggtcagagtgagaggaaggggcctctcactgtgctgcctcggctgttgagctcacacttctccctgcgcctgctcgctcctccatcctgcctcattgctggcccaaggggcctttaggagtggcccctggtgactgtgcaccccactcccctataccccaagaggagcagccagagctgcctgcgtctcttctgggagggagaggaggtcaggtttgggggggcataggaaaccccgcgcacaccctgcctccttaccactgcaatgcctgctcaggacagaattccagagctgcccccacaaaacagactcttagtccggagctgctgacaggcagggaggcccctgggcctcagccttttccatagcagccacagctggtcctgtctccacccctagcttccactctggggtctatagccaggtttgtatgtgggggattcatgtatgcggtacgagtgcccctgaagatagacaagaaaacccttcttctggcaaagcagagggcactggggacccctcaagagggaaacattgctgtgtcagtctctgaaccaaaccgagggtcccagtagctgtgattcccggctctgagttctccctcctcactccttgctctcctcacccattgcggtttgggctggttctgcctccacaatgaccaggctgatgatggccccggcgctcaaactgcccctggtggagcctctctctgaccaccctgtcttctttgcccttttcctccccaggtggtagtcaactctccagccaagttagtatcaaaggacagcatgtgtgtgcgcttgcgtgccagccccagcatgtgtctgcgtgtgtctggcgtggatagagtgtgcctgctggcatgtgtacatgtatgtgcatatgtatgagtggggtacacttgtacccctgggtgagcctgcatgtgtgaagctggagtagaagcatttgggggtgggagtgggggctccatccgatggttctaatttcattcccaatttcctgctgcagcagctgcttaagatgtgcctggggttggtgacggtggcgggcgcagggggagggggacacaggctgtgctgctgctgggcctgtgtgagcctgaagacctttctgtcctggcgacccctcagaagggctgcactggatcttgtctgcccggggagcgcacctatccattggagggaagagcctcctgtgggtagaggatggccagctactcagcaaactggacttgagggggcctgggcagctggagccctgctctgaggaagaagcacattccctgaagcgtctggaagatcagagccctgggccaccaagggggtggcctgcaggaagagccccttcacggagaaaccttgctcagaatccctgcgggtgccagtggagccgcttttcacctttggggcattctggactcagcttgggctgctgctcccgacccctacccccagccccatgcctgcgcttcccctgctgtgtgtagtgggagatctctctgtgcctggcagcccctgcagaccctgggagggagctcaggctgagccaggcactgcaggggagctgggaaagccaagatgggcaaggaaacccttctatggccaggagtggtggctcatgcctgtaatcccaacactgtgagatgccaaggcagaaggatcagcttgaggtcaggagttcaagaccaacctgggcaacatcgtgagactctgtctttacagaaaaaaaaaaaatagtggcatatgcctgtggtcctagctacctcaggaggctgaggtgagaggatcacttgagcccaagaggttgagactggagtgagtggagatcacaccactgcactccaccatgggcgacaaagcgagaccctgtatcaaaaaaaaaaaaaaagaaagaaaaaagaaaaccttctgctgcactgggctttgggggagggtgccaaggattttcttgaatacacccagaccacccaccatctggagacttgtgtagcctatgggggttcagggcctcggctctgggagatctctctcgacacccaccgcgcccagcccttgccttggccacccatgtaaccgccacctgttgcccttttctcctccctctccctgcccgtactcccgcacccctcccccagcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggtaagcgcctccctcctccaccgccactcagtgcctccagagcccgaggggtatgggccattgggcaccatcgggaccagctttcttccctcacgttggacctcctggaggcatggcccttggaggggagccagccttcaccagggccttctggaacgtgggtatcctctcttcagaccctctccatggtcagctttaggagaagggtggagaaatgcagaaaatggtggctcctcaaagtgcttttcacagcctctgcattttcccaggctctatgaggaggctggaagaagagacttctacagtcctcttaacaaggggaccattctggaggcccccaggcctctcacagcgaagctgtcctttaaggagggggaagttaccaggttcttccagcaatgagaattgattcaaatacactggctgggtttctggtttgggaaggggtctgcgaccaaccatccacactactgctggcaatcagtcccacagatgggagcaatccccttctttttgccctaggaagcccggcctcaaggcagtggcatttaagacatccttggttcctggaattcacccattagctatggctggggaatttgagggttggtaaagaaagagttggctgaaaatcatttgtggatgaaaaatgctagcaatgcaaacattcatgcagacagacctctctctgcgtgtctctgtgtctccctctctctgtatgtctctttctgtcttcctccttgttgctttttctctgtctctccctcccccgaccctcgtgtgtgtgtgtgtgtgtgtgtgtgtgtgtgtgtatgtgtctgtctatctgttgtttcttttttacacacatacacataattcctcactgttttctacttgggaataccactgtgttggctgattatcagtctcggcaacatcttatccctgggtcaggatcccctagcaattcaaggcaaaaagtcttgaaatgacagtgatgcttttttccaaagccagaaaaaccgatgtaataagagggatggagggattaaaaagtcccagagaacccagttgcacttggcctttccagaccccagcccttgtggccatgatatgcatgcaggttataaagggcaggctccccagccccaagggtggaacagtgtgggctctctgggctctgctggaactgaggagcctggggcccttttggagatgcagtacttcctctaggccaccagggagcagaggtcgcctgtcctggagtttcaagtcaaactcccaaggctcagggctgctgctcttcgcctaattctgggcaaggttgattgaattccatcattcaaagcagaaaatatgaccatgcaagtttacaaacacaagcattagctcatgcgtacccagaaaaacaaggctgcctaagcccaagagctaacagggatttcctgttaacatttctttgtcacgtgtgtccttggtgtgctcttaaaagtagtagcaatggccaaagggaagttcaatggagaataatgaaagaaatgctcttcactaactttctgttttctgcacgttgggaagactgctatcatttggtctcaccactagggcacccatcagttttggaattgatgcactgttgattaatcgagacttcacgaaggacgtttcccatctccctcctgtcccctcccatcccctccctattcctcccctggtatgcctggaaagggtcctcttctcctcttccttttaacgcagccacgctgagctgaccatgctgtggtgccagtgagtaaccctcttggccataacgtgctcccatttctgctgttaatttccgtggttccttcctcaatgaccgtgttttttctctttttcttcctccttcacccaccccattcccataactcgtttctgaccctaacccggctctcttgtgtgcgctgcccctctgctatcccatgatggacgcgcactcacggctgggttttcctctgcttggcagggcgtcaccgctggcgtaagtagaccctgcagtgtctgtccagtcatccgtctgtctggttgtgggatggtgtgtgtgggtttggtgggatgtgtctgaggaccagtggtcagcccacgtgctctgtccacgctcctcctcacacccacctgtcagccaaacgacatcccttgcagcctttacaggcaagtacttgtctcttggggtttgtccaaataatgtcactgtggtcacagaaatcacagagtagtgacactcatgctgcaggcccaggctgggggtgcatacctgtgttcttcttgccgtgctttggggtagctccccccgcctttcctatctgcactggaacagtgtagacccagacattagaatgcacactgggccattattcagggctagaaggtgacaaggtaacctcttggaggccactccccagaatcctcatgggaagtgtatctgcaggagccagtgcctgccatgaccacccatgggaggggaaagatgaatcagactgggggctgcacacagtgaagcaaatgcagcggtgacctgatgttgcggtgactgtggagtgttttctgtggcaagaagaacaagctgaaagtgggtccagagagtggactcaggccaagggccaaggactgcaggacctgttccatcttccctgcatatattctccctgagccttggtgtcatgaaaggcacagcagtttccttatctgactcccagtcttggtcacagcagcaacaagagtccctggtctttgcacggggttgtgggaaatgaagccagaaatgctttcttgaacccttggagccaagaaaggcacaggggagctcctcctgggcacattccagggaaacagcagcaaacaccttccacctgctctctggattgcaaagctctgtagagaggctcaagggccttgcatccacaccttccctcacccactgcacagttcacactccctccttccctcccctcccagtgggtcaggagccaggaccagggagacctggttgtgccttcctgttgcccatctcacccagaccttaggaacgcctgggactcctccctatgccagaaatggcctgtcccagcaacagcaagatcccaccctctcctttgctccctgggcagctgcaggctcctccctggccggaccctagaagcctctgctggtctttcccaaccgatcccaaccacaggctgccagtacctatagctctctgggccagggcagggccttcagcgaagccagggcagctccacccaacctcgatcacctttccccacctctgctcttgtagcccaccctgagccagacacagggaccagtcctgggacacaaggtcagttccctgtcacactccttgcagggagggtataagacatggacaatggggagtttcctctcccagccagccagccctctggggaaaagggagaggcaggcagaagagtactggacagggcatctttccaggcataggtccagggcctcccactgggcagaagtagccttcctgagccctatgactgcagggagcctaatggaaaggacacagggctagcagccaggaaacctaggttctcacccaatggggcccttatctgctgtaacctggagctagttggctggcctctctggacctcagcttcagcatctgtacgaggagagggctgggccagcagtctgttactgttgtgggcttcacctgagccctcccaggcctctgagaaggtgggctgggcggcttggtcctctggtcccccggccagggtgagtgggctgtaaggcttttgaccatggcctgcactgcagtctgattcaggctgggaggcactggacccgaggggctctagggtcccttctggctctgatgtaggatttgtttgttcagccaagagttttgtgcacctatcatgtgccagaccctgggagcctaagggaaggtcacctggtcctccacaaagggctgcgcttctctgggacagaggaccagtggcttccatgcagccccactcccaacttccccaggccagaaatcccctgtccctacaggccatgccagggctgtgccttgctgccttgtttcttaccactttccagcagagtcagcctactcacactgagcccatggcccccagtccttttccagggcagtgacagcattggcagctccttgtttggatccaaaagtgtgaggagggcaggagatggatcctgaggaatcctctgtgtcccccagttggcctctctccagccagccccaaactcacggcctgctcacggaggtcaaagaagacctgttctgtttcctccctctgtaaagggaatctaggggtggaaatgtctccggcctaggcctggagttagcactggggaagggcagacctgagggatctgagcctcctgtctctcatgagggaggggagtcactgcttcactgcgaccaatctgagcaccgagaacccaggtcatgcccatatctcaggttctcagacagcaatggataaaggcaaggtggggacagaacgataggggccaccaatgggcatggagcagggacccagcagggtgggaactgggctccagcctagccctcgcccacggcctctctctgcattacaggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcagtgagtgcaggctctcagggtggctgcagaggagggagatgctgaggggccaccagggacctgggcccagcactgcagaagccagggagtcctgctacctgcccttgaaggtgggccaggcttgatggtttgtcagtggctggcagggctccttctgggcctctcaggcaggctgtccggtgacagcagccttctgctccaatgccaactccagcagtgggcagcaggcttggtgtgcaacttccgggcgagatgattgcccagggctgggatgaggccctctcaggctaccccctgactctttcccaatgtcctctggggcctctgcccagcacacagtggacaggcaagggggcagtcaccgtgtggggcctggctgaatcctggggactcagtgcccacagagccccagcagctttccttgctgtgtctcccgtgagtcccctgaccagctcctttctaccaacagtgcaagaccctgatgaagaagctctgcgaaggtcaaggtaagtgcctggactcaggctctgtggccttgccctctagccccgtccctccccgggcagcccccaggtcacatcactcatggaagggacctctcaagttcatggatttggaaagcctggcctgcaaagggctccagctgacactagcttgaggcagcatcgtgagtcagtgaggtgggcacctggacccgagtctctgtcctccaggcccaggctacaagagcgaaggctctgggctctcccagcttcatccctgggcagggggcagggctgctttggcctttgctgggctgttgagaatgagggcaactttccctgtgaggacacccggctggccaacttgcccacccactcatctcagggcctgtccccctatgattccgaaggctgggcactgagaaacaggcacacagggggctgtgctggacgtgaacgcctgacccctggactcacctgtccagacccacattgaggtaccagttctgtaagttgctcaaagcaaaatagttgctgaaaaaaaaagaacaagccctggacatgaggatgggtttgtgccaagctggggtcttagagcatggtttccccatcagttgcaggtctgaggccacagccaccaacctaccactgtggcccgtcaggtgctcatagcatgaggtgggcatgggggggggcatgccatcctggaactcactggaacccgctggggccttccatggtaaggagtagggctcattgtgattgtatgtacacttccggtagcaaatatgtcatctgcatgttcttcccggcactgtctgccttgggccagtgcatcctgtggcagcctctgtgcaaggggctggggctcagaggcaccctcccatcctgggccaagctttctgtacttgctaaccagcaggcccaacactcagtggccatgtgacctgtgcagagtaggactctggagccagcttagacttgtggattttatttttgaaccaacacttttgccaactcaagttgctcccactttttggccaggcatccaagcctaaggtggggtcctcccaggcctgctaaggatggcatgcagtcccaataacagttcttaacccttcagtgcctgcagggcatctagagagtccgcgatgaagtgatgtttgatttagctcaaaagttaagctccagctgctttaagtgccagagctctcagctctcccctcccgctgtgctccgctgtccctgcgtgctgctcccatgcttgtcttgccctcctcttagaagccacccatgtagctgcttcagtgtgcaatgcagatgttcccaaacatttgataaaaaagtctttaaatcacacaccccagagcaagcggcttcaaaatccccccgggttccttccagcaacaggccagcagggggccttttttctccctcctctgagacccagagtcctgccttcctggctcccttctggttccttaatgttctgcttccctccgatatgcaaggcagtcacgctcagcttgtgcctcattaaccagatgtcattagaacgggaaagagtaccgtggaagtgcattgcagcaaacttttgtcttttctttcccctggaatatttgcaggctctgcaaagttattgagtgaggagagcacaaaggcagtgttgaaggtggtccccaggcctcatccttggccttccccttccctccttcaaggagcatctcttgaagtttgttctgcctggtcttgagggtaattgaagggtgggagagtagtcctttcaccagcggcctaaccccatgaaagtttggttcagcctcagcaaaaggcagctttcggagcctctcccccagctacggcagggtttcatgctagggaaatctggggaagagggcctgggaagtggctccagttagcttcctccctcagtcccaggcaacttccctcaccccatcagcacctctctctggggtctcaggccctgcagtggaggctctgaagcacccagccagcctctgcccaggtctggaggggctcctctcccttcttctgactttaatttctggagagttatcctcgtgggcagagccacccatgtcactgaatcccaagcagtgatcccatggacccagaggcaggtgcagtgggtgtagcagttctaatctgtctgtgattgaagcctaaagcagtgtgtgtgatcactggtcatgactggggccccaggctcacctacatcactatctgagcagaagggaacatgccttgtcccaccctggtccaggctggtcaggggtcttgctcctcagaggcctgagccacacttctatctgtccccactcccaagttcgaagctgcacccctagactctcctggcccatcttgttggctgagagcagccacctaccttctctttctcctcccaaatcccagcggggattctcagggtctctcttgaaggctgagtttccccaggaaggcttccctgtaaactgcttccaagtgtctcactccagcagagcctgggtttgccaatcctgtgcatggtgacacctacacagtcttatgcccatgcaaaggtgctttctccttcctggtgctgtgtggtgctgtgtggtgagaaagttagcgggaatgttgagtgagtagtgtcaggcattctgcaccaggcaggggctctgggacctcgaggtcaagtgtgaatacacatgtcaagaagactttgcaaactttcccttcacctccatcactgctctgcctccaaggtccacccccagagtcccagggcagctcacagccctcttctcctctcgggtcctggctcctgatggtatctctgtgtctggtagcacgtagcttccatctgaggctccagtgccaacctgctggctagcccaagacagagtctaatttccagggactctttacaggtgaggtgggggaggcctgaacaggccaggcatcagctatgaacttcccaccctggaaggaccaggcaccttaggaaactgtccaggttgccttgaacatcagccttctgcctacttccacatgggaactactctagtaggtataggtgacgctgtggctccccagtttccatcggaggtagctgaaatagtgcctccatcccacaaactgagcctctaatctcagagtcatcgccacagcttccttctgactttggaaaggcattccagggccctgatcactcaaaaggtcagatccacattgggcagccacattggggataggggtggggacaaggcagggcttggatctgcgaggcatctggatcccactgctggggggaactatccaggatgtagcccagcatgtaacccagacatgcccctgatcccttacaagtgcagcctctgcgtttccctgatgcctgcctgggtaaagagctctgcatctccccatctttccaagcgttaggaacaaagctgatcttagtgaagagtccctagaggagctgaaggtgcatcacatagccctttccatcccagatcatgcaaaaatccttccatgcccgttttctatcatgcagccattaagcttcttccaataagatgccagggctcactggctccccctcttccctcctgcagcctctcagatgcccccttccctccctctgctgcgcagtctctcagttttgccccccctgcagccacctcgcttacacgccgcacagcatagggccctcctgccaatgggtgcccccgccaatgggccccttgtaagaaagcaatgaaaaaattacctctcttttttggattttgagtccctggtgttctgccaccctagcgagtttgaaaaccacaactggagcaccagggatgttgccccaggtgccgctgcctgagcagcccctgggaggtcgtctttcttgctcttgctctcctgtctcttttcctctctcctgtgccttcctctcctggctcctttccttggctagctgaggatttttaaacagcttcaagtagagcatgctcactagattggactctccaggactgtccctgtccctgtcactaagcactaatgacaaactatcacccagcctccacaggccttgctaggacttgacgatttacaggcaaactgcctgtgtctgatcttgtgcccctgtgtcctcggtagtgtctacgggatggtcaggactgtttgtagtgctgtcagcaggactcaaggagccccaccacatggactttgctcatgccatctccacccctttaccccaacctcagataggcaggtatgtggcaagggaagaagacgctggcacttagattgtgattctgcccctgagtttctgtgtggctttaggtcattcatgtgacctctctgggcttcagcttcctcttagtataaggaaagttcagactagactggtggttttcaaatatgttatatgttagcagtgggtcccttttgtcaaacagtcttagacagagacccagtatgcaggattcaaggggtagagagagacagagactgccaggtaaagcaggtgcagaaccgaggacctctgtgagtgtggggacatgggggccagccccgatgactgttactgtgcagaaatagaaggccagcactgccacatcttcttttcaaagacttaaagttgctcttcctgatttttatatgctagcaattcacttttttttttttttttttttttttgagacagagtcttgctctgtctccaaggctggagtgcagtggcgcgatctcggcttactgcaacctccaccacccaggctcaagcaattctcctgcctcagcctcctgagtagctgggattacaggcatgtgacaccacgcccggctaattttgtattgttagtagagatggggtttcaccatattggccaggctggtcttgaactcctgacctcaagtgatccaccagcctcggtctcccaaagtcctgggattacaggcgtgagccgccgtgcccggccaacttcttttttttctttttctttctttcttttttttttttttttttttttgagatggagtctcactctgtcgcccaggctggagtgcagtggtgcaatctcagttcactgcaacctccgcctcccgggttcaagtgattctcctgcctcagcctcccgagtagctgggactacaagcgcatgccatcacacctggctaacttttgtatttttagtagagacggggtttcaccatattggccaggctagtctcaaactcctgacctcgtgatctgcccacctcagcctcccaaagttctgggattacaggcatgagccaccacgcccagccaacttcttaattaaactttttattttgagataattgcaaattcagtgcagttataagaaataatagagatccctagttccctttacccagcttctcccaatggtagcatcttgcaaaatgaaagcacaatatcacaacgaggatactgacactgatacaggcaaaacacagaacttcccttcacccaggatgccccatgccgcctttttatagccatacccactcccctccagcacccacccacctccttaacctctggcaaccactaatctgtgatctgtcctccatttctataattttgtccttttcaagaatgttatataaatggaatcatacagcatggtaccatttaagattggccattttttaatcagcataattcctgggggtcacccaagtggttgagtgtcccaatagttcatctattcccttttattgctaagaagcatctcatagtatggactcagaaattaatctttaaattgagttggaagcaccgtacaggttaaacatactgtgtttgtggctggatggggccctttggccaccagtgggcacctctggtctggaggatgtgatcggcccttccagcctggaaggcctggattctgacgcctgtggcactggcctttctcaggtgctctcttcctccattcattcccacgtttctgactgctgcttgcctgctctgtactgtggcctcagctgagcaggtgtggcttgagccccaagaggccccactggtgggaagtggccagaagtcctggccctgtatctgtgacagtgaccttgtgagtatgtgtgggtatgcacgcatgtgcccaggctgtgctcaggcctggcgagcaggggtgggcaggggctgtgtgcaaaatcttctctctggggacagtgaggcttttcgaggccagggcagcacagggaaggggcaggtctgcccaccaagcctcatcacgggggataggtgctccttcttcttgatgcccagctaggggacagagatcatgcgaggtgcacctgtctgtttggttcaatcctgagagctcacagccaaagcagccctgcccagccctcactacatggaccagggaggccctctttgctcagtctgccctcagggccattagccaggtcccttctccacagcccccaactcactcaaggcagggacttcagtccctccatcctggtccccaagactctcggtcttcccctaacccaggcctgacctgggttacaatgtaccccatggattgcatagcttctccaagcccgttccctccctcccatgccctctgccccacctgttagacaggggaatggtgaacacattccctaacccctttcattctccctctcttctctctctttctgtctctgtctctgtttctctctctctctctctctctctctctctgtgccacagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaaccacaccaagccccagtcatgctgtgcctgtgtgtgtcccacccaagaggggctgtgagggcatgatctgggacagagagaggacaggcaccatcagaagaggagcaggggctgtgtccaccggccccaggacacagcgcagctctggtcctgctgctctcctgccccacaggttccgagcccagctgcaacccacggcgggaggatggctggtgggaatctgtgctgaggcccattgggcaaccttagtcacccacaggacagtgcatatgggaatactcgaatgccccctgcctctccttccacaccctgctgcaaccagcagactgagccattgtcctgccccaccccatcagaaggcaccccgcaagctgttctcacaggaaggagctacttatgctcgatcctggtccagaggcgagagaagggctccagtgggcacacctgggctgagaagcagttcacaagggaactcagggggccagggctggggctcaggggaaaagagatggaaggcagccctggcagattcttgctcaagtggcaggaggcaagagggctgggaaggcttccacctgggtcttgctcccagctcccacccacctgtggccttgtcctagtcctgggcatttaggaagggctaggaagggcagcagcagccaaaaagatcccagccaggcctcaggctcatgtcctgctgagctgtaagccactagctagcaccccattcacctgacccaggcctgaccacttagaaagtaccccatgatggcaaagcttctccaggccaattccatgtccctgattgtgtgaaatcacaggctgaggacatgagagtggtggcacttacattagaagcagatgctgaggcccagccctcaaggctgtcctgccttttctgtggctgggctagccagagctctgcgcccattcctgctgcctgggcagaggctttccctctgcctccaggaaccttcgcaatcccaccaggaagcgttggtgtttgaggccgctctctcctgcccatccaccctgagatgctccctaaagccccctgccaacctattctggcctcccaccccatcctgcctccagcagtctgatgcccgggccaggcagccttcatcccgctgccttcatctaggcctcctggaacacactcatatttggctgatgttttacagaggacttgcaaggcccaagggtgggttgggggcaggggtctgccagatagagagaggtcctgggcaatgggtatcctgaggctggcaaagcctcagccaaccactaagagttggcgggctcttggacccctgctcccagaccccagcctgtcggagctctcttggagccacctagttgaagccctgccttcccacctaccccagaccccttcatgtagtgccctggggggccccaggctgggttccatgtaaacccctcagtataagcaggagagatgttctcattcagcatccggtgtctgtgggcatttgtggaggtgcctgactactatgggtgctaaaggaatcggaaagggccgatgcggctgtgttcccaatgcaaggttgatcatgtatggtccagagacagggagcatccctccaagtggtggatcaaagaaggcttcctggaagaagaggtcagtgtattttatcatcaggaatggttagaatttgggtggaagcagatacaaaaggctggacagatactctaagcagaacaagcagaggtgctgatgagaagtggtgtcccagaaccccaagttaatcattttagttggaatggagagaatgcagaggatgtcatggttagtagtggtctgcatctagactcccaggctatgggattttgaatgcattctgaaggaaagtggaactagcaaaggctgtagggtgcctttcacactatagctgatgaggtgttcttcatctagaccacaatggcaatgtgggccctggagttgcatggagcattcctggggcaaagtgatgcagctcagggttcccctgagccatagtcaccaggcagcaaggtggaacatagaccaggtgggtggcagcatgaataatttcaagaccaaccacctgactggcattctatcatcacccaatcaacagagattttcatgctctaccatcttaactaacacaagtagcatcatcacccccacagtggcaaccaccccttcagcactgtcaataccaatcacaaggcccccaccatcaccaacagttctgaccaagcccagtggcaacaaccccaagacccagcatcaccaccaccattcccatcctttccagacataatatcatagttatcaataacagcatcaaccaaaccccaccattcccaccaccaagggccaccatggaagagcaggggcacacagtcaacatgctccaccttgatgctgaccagactgagggaagagataagctgaaaaggggacgatggtcaggctgtgtttctcctggccacgccaaccccccatggagccatgagcatgtgggcctagtttggtttgatttggtttttgcttagatgtttaaactgaattatgactaaggcaggaggcaactgtagaccttagatcaggatggggtgatctcaccagcactgtccttaggaatgaagccaggaccaagtaagttctccacagtgcttgctctatgatgcccccttcagaatgcttcagagggtttgtggaacttcaggcaggaactgacctggaataagagcccaagatccttcaagataccctttgatgcctcctctgccttccctagccctggcttcttggtgtctttagacagtgtgctagagaggatgctactcagcaagaaccccaagcagcaggctcccttacgtgcatacccaggtatacctggtggtgatcatcgtcctggtgctgtggtcaatgatgaattttcctagggcccacatccagctccaacttcatgccctggaatccagggttcatttggagctctggctgcggagagcagcaggtaagctggcctaacagtgaattggagccaaggagacaggcaaagccaacctcctattcatcctacagaatattgtccccagcctggacactgtcattgtccttgtcctgtgcagtgtcctcatttcccagcagcctactggaagtgtggtgtagggccatggagagcagataaaggagatcagtgttctgtgtcagcctgagccgtcccaggccatacctgcccacactgagaggagggtctgagcagccagctcagtggcgtggctacagagactgcagctacttctctgaggcagtcacatcaccggcatggcttccagaagcgaggttctttcataggtgggttcgtggaagggccagggccaggcacggctgcaggcctgcaagctgggctgcccaagaccgcctccctgagcattaagtcagggaagacctgggcaggatgtaaccactgctcttgcccatcccaaaagcttcccacgcagttatggagaaggatggcactctctctcccatgggggcagtcaacctcaaccttgccacttctccagctccattcttccgtgaccctgtcacaatatttcatgccctttttaccatacacctcaccagatgaaggaaagtaattcagtaatgcttttgcaaatagctgagggcccgcttgcattcctatctagggcagacccctttagtgtcagctactccaagtgtggcctgtatacagaccagcagcatcagcatcacctggaagcctgttagaaaagtggactcttggccgggtgcagtggctcacgcctgtaatcccagcactttgggaggccaaagcaggtggatcacctgaggtcaggagttcgagaccagtctggccaacatggtgaaaccccaactctactaaaaatagaaaaattagccaggcatggtggctcatgcctgtaatcacagctactcgggaggctgggacaggagaattgtatgaacctgggaggcagaggttgcagtgagccgagatcgcgacattgcactccagcctgggcaacagagcgggactccgtctcaatttaaaaaagagaaaaaaaaaaaaagaaagaaagaaatgtggatgctcagttctgccccagacctactcaactaggatcaacttcattttaacaggatccccaggggcttcaagcacacatggaagtttgcaaagtgttatagtggtgaggccccaagcccttttttgccattttgcagctttgtgatgttttactagagacacaatctttctggacctcagatttctcatctacaaaatgagggtcacaatcccaatggctcagggaggtttaaatgataaaattgagtaatagggtaatttctttttttttttttaagatggaatttcgctcttgttgcccaggctggagtgcaatggcatgcatgatctcggctcaccgcaacctctgcctcccgggttcaagggttcagccccccgagtagctgggattacaggcatgcgccaccacgcccagctaaattttttttttttttttttttgagacggagtctcgctctgtcgcccaggctggagtgaattggcgtgatctcggctcactgcaagctccacctcctgggttcacgccattctcccgcctcagcccccaagtagctgggactacaggcacccaccaccacgcctggctgattttgtttttgtatttttagtagagatgaggtttcactgtgttagccaggatggtctcgatctcctgacctcgtgatccgcccacctcggcctcccaaaatgctgggattacaggcgtgagtcactgtgcccggcctaattttgtttcttagtagagacaaggtttctccacgttggtcaggctggtctcgaactcccgacctcaggtgatccacctgcctcagtctcccaaagtgctgggattataagcataagccaccacgcctggctagggtaatttcttttactgtggtaagcacttagtaatgcaaagtattgttattctaattatttccaataagaatagtgccttttattggggaaagagtctacttggctgatcacaacaagaggtttatttcttcctccatgaggtaccggttaaggattcaaatcacaacatccctcaatcagatcctgctattcttactgataagttgtaggaccttgagcaactgaattctctttgttaccatttcctcatctattaaataagagtccatgataccaacatcagagggctgctgtgaggaagtaaagacatcattcctggcacatagcatgaggtcaataaacaaactgcatagtgtagggggagtcattcccacttgcagaagctgcatttatccagttgctgttattgcaaaaacaaatcaaagagtaaagaatgtgcatttctttgctttcctataatttaatttttattctctgcccaccccattttacagttagcaacccagctctgactgctcttgtcttcctagagtggttctagggaagaggtgcttacagaatgccaaggcactcagggtgggggtgtgggggcacacctggtcctctgtcaggttctgcctgcactggcatttgctgagacatccccaacccgtctggtccacactggcagtgtggtcgcctttctctttcccagttacaaggtctttcagatctgcaggtgctcaggaccatgttcttgtcactcttgggtgcatggcaaatcctctagggcacccaggccacacagaggcatggggatctttgggctatttcaggtctgcctggcccctcaccatgggcatggggaaccctggggtcctgctgcttcctcagggttgaccttgaaaaggggcacaggggcttctattcttgaatccccttgccacagtgcccacttttgtccaggtaaccttgctctgcctggcatggtagctttcagccatctgtcttgttggtgccctgagtccttccgagcccaaagcctaggttctcacaactccagagcctaagcccttgacactcaaatatcttcactctgctttttttgctgtatcattccttcccaaggtagcacatgccccctgactgaatggggaagggtgaaaacaggatcagggaggaacctgggtggataattccatcggcctttctaccacactgttttgctgaaaaagaaaaattaggaagtacagaaaaatttgaggggtgggggtgggaaattcctccaggattgaaaaagtttttgatgttactggaaccctcctgtggtctgagcctctgctcctgggatcctggaggagctccttccctgagctggaagacacaccctctgaggatcctactctgtttgcaaggcaggtggagctttctgcccagcctgcctctgctgcagccacctgcccccatgcagaggggcctcacagggtctctaggctcccttgacctgttgtctttttggtcccgcctcatcagcacccctattgagcatgcgccggtgtgcaccagccaggccaccaccccgctgctgcccgcttctgcccagccacctgctgctgcctctcccagtgcggcttcgccacccctggccacagctgctgcccacactgccatcgcctccgcctccaccacagcccctgcttcaagtcctgccgacagcccaaggtaactgggccacaggtgctgggcctgaccctggggaagggaggcaggaaacgccccactctgggtctacctgtggccagctgtgtccaaggtagttagggcccgcaggcctagaggaagccaaggccagcgctgcttggtgcagagtgtgaaggggaaactgagggtgaattacaggggtgtgcaccactgtggcggggactgtcactctgccccccagggacacatacaccggtgagagaggtaacagtgtctctctctgacacatataccagtgagagaggtaacagtctctctctctttctcacagacacatacacacactcatacacacaaagttagataacaaaaggggactgtggaaaaagtctttgttcctggaactcaaattagatagaatgaaagttgtccctgtgggctggagaaatcaaggaaggctccatggaggaggcagcattggagctgggcagggaaggcaggtcagatttcctcagagagttcagccatgttaacgccagaggcacctggtatagtgggatttatatctgctccacagcttactgtgtgtaaccttgaaaaagtgactgaagctctctgaacctcagtttcctcatctgttaagatgtttacctaacacttattatatagaattatgatagaaaaaatgtctgtaaaacacctaatacatatgaaggacacaagtattgtgagttcctgcatctgccctcctagacacccagcaagcagagaccaaaggccaggggagaagagcgaaggcagagaggccaggctgacaggtcactctgcagtggccatgtggcgcatcaggctggatggggccagctctctgtctgggcttccaagagtaggccagttagtgtttggggtcagagcccaggtgtcccaggcctcccaccctggcccccacggtttgctggggaggacatgcctcttggatcaggatgggtaggtccatggtgcagcctgaggtgggattgatgtgagcaaaccggcttgcaggcctgtctgctgcccccatcccgggcttcacattaaccacatggtgccaagcccaacctttccccagcccaactcaagcctgaaggaggagcctggccctccagggatggtttcatcccagtttcctggggggatttaggacactgcttcccctctttataccagaatctcttcatataaaggccttgctacctgcagaaagatgaaactttgaggagggcaagaaatgcctctgtttttgagtgggaagaagcctcccaatatgaatggtgaggggctataaatgctggagccctgcaggcagtctagcctcatccctggggccccaaccctgctcaaaggcaggcaccagcaccaggcttaggtctcagtgtcctgggcctgcccacggctgagctcctggaacccttgggatgccccccacagggggagtcctcccttccttccctttgccttgccaggagagctgggacctgggtggagcttggagaggggcacagagggctggctgcccagcggggagtggggctggagcagaaggggtcacgggtttgcactctgagcaaagctacctccgctcctcacacatgggctggggtggagcgggaggtgggggagcccatgggaggcaaatggactccccagcctttcatgggagcatggcttcagaattttcaatggatgccataagcctctgctccctttcccagtgccagtccctgactcaggacctgtagctcctgggctgtgggcaaagtgtcctccaatgatggagtccagctaagaccactgcaccttggcccgcccccatcactatggaagcctggcaccccttggacactgtctcttcctcttccatggagacccctactctgctggtcttagcacaggaatctatccagagaagggcaggtgggcctggggaggggagacaatagcttcactcagccagaaactcggcagcttgacagggcaagtgtgcacagccccctggtctgggatgccagctccctgaggctcattttatctccgccttgtctgggacagcccctcagacctctctggatccactcagaagcttggtggtgggttctcatgccagggccagtcccttctcagagccccagagaggaaggcactcctcatcctacagctctgcccagcagggatcggcaggccccaggtccttgaggaacagacagaaggaaggcagaaagccatgtgggggtggcaggcagggctcacttctccagcacctctagcaataacccatttgccctgggtgtgggcatgtggtcccctttgagatctgaaagaccagggatgtgttctgcaaggtgttcattagttttaaatgaagaaaagcattttacaaacaaatacaattggggaacactgatcagacaaggctcaacaggccgctggattccaggagttctcagagccttcagctctctgggaggagaggccacgacgcacagactctcctgagggtaatgaactaggacgctttttttaaaatctctttgaccccattgtccctgggccacacatggggaaaggtgaccctaggccccttgaaaactaacccagttggaggagggcaacaggaactctatgcagaagaggtgtgtgttgggggagaggggggtgccttgggcagcaggcgggggcagtctcctgacttcccctgagctctcactggagcatctgtgcccagaaacctgagactttgctgttccttccagcaacaatagaaaagggtaggcagaagaggccaggtggtcaggggctgaggtgccccacaaggtcgtgggggtaggtagttctgaccagcgccatctctctcctctcccctacctatgcgctcttccacagtcccacctggacagtctctccccatgagagtgaagggtcttcccggtgtcctcctggtggcttttctccctctctccaaaggcggtggcactagccacccaaggaacatcctcctcccctccaagaccctcatggtccttccttcacagtttctggcagttccccagaaatgtctctgtcaggtgtcctcacagaggcttctgaagacctgggagccagcctgccttgactgcaggccccagtgggggctgtccttctgggtgtaacccctccccgcttggttccaggccccaggcctcttcctacagccccgcagtggccgcctcttcagcacctgccacccacaccagctacagtgagggccccgccgcccctgcacccaagccccgggttgtcaccactgccagcatccggccttctgtctaccagccaggtaagaggcagagcaggaggggaggctgtcgaaagccatgggcgggctccaggagccacaagagccaagaagtggctctgggggcacatccccagaagaatgggaagcaaggccttgctaatgatgctccgccctccgtcccctagctgtgggtcagaatcctatggagcctgcatctggtctgggggagacaggtgagcaagaaagcggtggatgattctaagggagagcgaaggagagcagagaagtcttctccggaccgggcatggtggctcacacttggaatcccagcactttgggaggctggggcaggaggatcgcctgaggtcgggagtttgagaccgccggggccaacatggcgaaaccccatctctactaaagattcaaaaattagccgggcgtggtggcacccacctgtaatcccagctactcgggaggctgaggcaggagaatcgccgggaggccgaggttgcagtgagccgagactgcaccattgcactccagcctgggcgacagaatgagactccatcttctctgtgtcatgccagtgtgcgagatttggccgcagccatgggggtacagaacagcacataaggagcctagactcgggagcaggtcctatccaggcgcagggagaaaccccagggaagttttctctgccgctggagcccagggagatgagacaggcactgagtcagggcaggccttgcttcggggcgctggttcatgaagctcgctctgacagcagggctgagtgtgggcggtcgaagcggcttttgcccgagacagaggccggtgccacggcctgctctgctctcgaaggcaaagtgcctcatccatccaggctgcgctgttcatggacaccttgtgttctggggatggaatgaagcacccagcacagcgtctgtcacacgggaggtgcccttctctgtccctacagagaaggggcaaggatagacggttctgaggtgaaaactccgcagggcgaggtggcattttgcagtagtgaaaagccttagatggagcagtgggaagaggctgcccctgcagagactgggaacacagggaggggaggctggagaggagttggaggagaagcggcgggtggaggcgaggccttgccggggcacaaggaggacatttccgtctcttcctggggaggcgcttctggcaccttccggggcggcctccggctgtcttcgcccagcccgccaggcggcgtcagggctccgggggcgcgcggccagcccgccctgcgtctccttcctcctccttcccgggctggggcccaggcgagcgagacgggccggagccgcgggcccccgcgccgttcccaggccgcgcagacattaactcattcctgcctagggggaaagaggcggccgggcgggcgcgcgctggagtcggcctgcctccacctccctctccgggaggcccggctgccaagcggagtccgggggcggctggcaggcggccccgtatgaagtggggcgtgtggtcccgagcccccctccgctccccttccctccaggctcttcggatccgggcgtcagagagggcggggagcccgcgcgggacccggagcgccgcggccgcagccgcagctccccccggggcctcctccgggccgagggcggcgttcgcaggccggatcttatcgctggcgcccgaggtgggcggccgctccccggaacacctgaggcccgggagggggcgggcggcggcggcgcggagaccctgcgcgcgggccggggacggtcacgttggcccgcgggccgggcggcggccaggcgcttgcggagagccgggcccggcccggcgtgagtcagaaatcaccttgtttaattacatatccccgagcccgccgagtgcgataggggacttttgaacttgccaattagagatgaaatatcaccttctaatttagactggcttaattccgtcacgcaaaaatagcaacagccccggggctgcgagatgggatatcaggtctctcctggcgtgacggcgagccaggctgaaggatgcagaagctgagggctgcgaagcgccactgcctgctcgccccccgacggagtcggggttgcgacgggggaacggagctgccgggccgggccaccgaggccggggaggttccttctctgggtgggttagccccaagcaaggaagccgtcaaatcggggtccagattctagcctgcctctgtgagacctctgtgttgtgggggctggaaaagaaaaggaggtggatccgggagtctgtaaggccttccgatggagggaagcgactgccaggcagggggaatagggttagtattgctggagggaggcaggaaaggtgggccagggccctgtttacttgaaagggggcgtactaaagcctgttttgctgcttggggagtttctaagcgggcatctgctgttgagtctggcagcctgagctcgtttcggctaagcagttcaccagctggatgacttggaggcagccatttaagctctccaagtctcagttcctcatctgtaaaatggacttgcaaatattatctgcctccttggattgcagcgagtaataaggcacgtaaagggcctggcatgtggaagcagtcattttggtgaaggcagcaccacgcaatagaaatttcctattagccacatttttaaaaaataaaagaaagcaagttaaattcattttaatatattttctttgactacatatatttaagatatcaggccggacgcagtggctcacgccagtaatcccagcactttgggaggccgaggcgggcggatcataaggtcagaagatcgagaccaccagggtaacacggtgaaaccccgtctctactaaaaaagtacaaaaaattagccgggcgtggtggcgggcgcctgtagtcccagctactcgggaggctatggcaggagaatcacttgaacccaggaggcagaggtggctgtgaagccgagattgcgccactgcactccaacttgggcgacagagcaaggctccgtctcaaaaatatatatatatatatataatttcaacatataatcaatataaaataattattaatgtgccttcaaaatctggtgtgtgttttacactaacggcacttcttggtcggactagccacatttcagctgctcatcggccacgtagcactatgtattggacaccgcaggattagggcttctggtcttaatctttttattttttgagatggagtttctcttttgttgcccaggctggagtacaatggcacgacttcgactcactgcaacctccacctcccgggttcaagagattctcctgccttagcctcccgagtagctgggtttacaaggcgcccaccaccatgcccggctactagaagttttagtagagacggggtttcaccatgttggccaggctgatctcgaactcctaacctcaagtgatccaccggcctcagtcttccaaagtgctgggattacaggcgtgagccaccgcgcccagccaatcttaatcttttttagcagagaattgcacttcacaaagaaaggaaagaaaatgttgcacagaacccccttatatataacagagggatgaagctgctctgaagttgtgctagatcacctctccctgctctctgtccctggtggtgttcctggaatcacttcttcccccagcattttgatattctctgcaaagttgttagggagggtgacaatacctcaaatttgggctgtacacatttacaaaatccattcactatgtcaccccagcaggtccccagcatgccctgtggggcaggcagggtgtcaggcattccaccaccactgaatagacctcagtctcaggttatctgacttcaggatgttccatttcccttccctcctctcccccaaccctaggcgctaccagtctaactgggctgggcttccctaggtgagcagcaggccatgagacaggctgacagtacatctgaccctgacacccaggttgcccccatccttgccatcctcactcacatttagtgacacactatgccaggtactaggctacgctctttatatttcttaccttcccttaatcctcataataaccttgtgagatactaagaatcagtattgccagttttagatgaagaaattgaggcccagagaggttaaggaacttgcccaaggacacaaaaccaggaggtagtagagctggatcctgcagccagggctcttggctatgctatcaagactccacagcagggggtctccttcatgttgaaaatgactcctccctgacatgttgcactgagattttctagaaattggactcatattctttacagaggcagcttgggatgatagaatgaatggatttggagatgtattcccacttactagctctgtctgagcctcagtgacctcaagtgtaaagagggaataatgtgaagaccgattcagatgacagatgctatgtgcctcgttacccctaaaggggaggaagattccttatggagaaggtattatcttttttttttttttttttttgagatggagtcttgctctgttgcccaggctggagtgcagtggtacgatctcgggtcactgcaagctccgcctcctgggttcacgccattctcctgcctcagcctcctgagtagctgggactacaggcacccgccaccacacccagctaattttttgtatttttttagtagagatggggtttcaccacattagccaggatggtctcgatctcctgacctcatgatctgcccacctcagcctcccaaagtgctgggattacaggcgtgagccaccatgcccaaccggtattatcttttgaaggcctcactggcaggatggctccagggcagggctgtggagggttttatctcttcttccttcaacaacatggatggatcctatctacctggtccctactcacccccagcacagggatttccagctcacccagctctgaagggtgggtcacctgggagtggaaggtgcagagtgggagccacaggctgccccaggcggtccaggggaaccaggtgggaaagagagactggagatggggccagggtcttaggccctaaggaaaaccttcctctccaggttgaggctggagtatggggtggggggcagaggcggggtgtgggtgcagggactgcctcaatgcagtccatcctgcccatactgagctcaggaatggggagggaggctgtgctgacatgcttcctagggttgggggaatgaggcctctttgctgaggagcagactgaaatgtggtgaggcttctggaacctcactcactggaagaggaagccagctggaccttgcctgcagggtgcagctgggtctgccctggctaggtgttgagggcccaggcgggagagggctgtgggtaagcagtggcaatgctttttctgtgctgtgagcccaaaacgtttttctgctctcagggagctggaggagggggtgatagaagtgaggtggtgcattctcttccctgtgctctgactgcctgggcaatctttagacagtcactcagacacactctcagcttccaccaaagcgatgtgggagtacaggggtcccccaaggcagccacgggccaagtgagcagctacttctaggctgtgtcaccctagagtctctgcccagcaccctctgaatgactccttcaagatcccccaccctaatcaaaccaagacggaattgccccccaatacaaatcaagccaagctgtttttcaagaaagtaattgtagctaaacctgaaacctgaacctgaaaacccagctaccaggtcacctgttttgtcctgagggctgacctaggtccaggttcagcaaacttatgccaagggaggtatttcagatgtcaaatcactggtcagagtgcaactgaaagcatcttgcagtcaaaggcgaggtgacccactcccacctctccccgcccaggtacccccacccccactctgcgtcttatgcaggccttgggcagtcaaggcctggcggagccccaccctgcacagctgcaaatatttatagccatgtcccttttccagccctgtcgagggttctgctgtgcttgctccctagctctgtgaacaccctgctgagaattcaaatctgggccatcaagaagttcaggaacaagtctcccaaaaaaactgaaattgtactgctctaatgttaaagtcaccttttgcatttctctggctaggagtgaggggaactgggaagaatgaattcctgacacacctttctttgggttttttttggcttttgcagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggtatggtccagctgtgcccctgcactggggcactggaagggcgtgtgtgtggggtgcttgcccacagtctgagccctggttgggagagatgggggtaggaggcaggtgtagggagaaagcctcgggtccttctggcttgccatctggtcttacctctctgagccttagctgccatacctgtgtgacacccactctcccagggagctgggaggaatggcatgaggtatgtgggtgaagctccagcaggatgcctggtgccaggaactcccccttgggctaaggttgaggtctgggaatcaccaggcttgtcagtaggtttacagggcattttgttagacagtgttggttttgacccagttttcctttagggttgtttctgggtctttccacagacaggcctgggctgctcagggggttggtgggcatctgccagactaaaatgaaaacaagtgatttcatacttagaagccatggaccatgggtgctgttgtttgaatacagtatgtttgtgtgcatgtgtggtgtgagcttatatacgtgaaaaatacacttttatttaaaactaaagtaatacatactcattagtgaagaattggaaaacacagaaaagtaaaaattagaatataaaaaaatgtcttcatagtcccactgttctgactgctaacctggaactagacaatacaagtttgtatcctggtctaccacttactagccctatggccttaaacaagttgttcaaactctgtgtgcctcaattcccctatctaaaaatgggtattataatagtacctagtgcgtaggattgttgtgagaattaagcaagttaataaatgcaaaagtcttcttgaatagagcctgacacagagtaatcacttaataaatgttagccatcagcatcatcattattgcatttcttactatcattatcagtggtcaactgaattctataatatgtttacccagtcccctattggtagatgtttgagttgcttcctgattttctttattgtaagtgatgcaacaatgaacacctttctgcatggagctttctctgaatttcacattacttcatcagaacagtcacaaaagtcagagttattgggtaaaagtataaacagtgttggggttcttcaaatatctaattccaagttctgggagctgccttactgggtgccattctgtgcttccccaggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggtaagtgggaggcctccatttcctctgacccatgtctcttccccagcccttccccaagatcgtgggatcccattaggaagccaagaagttgctggtaacagagaaagcaactccatttttatcctaaaagggaattggtttgccaccaataaacttggggataaatgaacttgatgcaagagatgattgtgtgcctgttccacacagcttgaagtggtggtggaacttctgcaaagcaagtggttgcttcacagcctgaccttaccactcaccagaatgtggccttaaccctcaatgcccctttggtaaatgacagtaataagcagtacctcctcccaggtttaatgggaggattaagcctcacagtttatgtaagaaagcacagaacctggcacccagctggagagtgacaaccccttctctgacacccctgggtctttcttcagagtgaccaaggcctgcatcctgagatctcctgccctgttccctggtaggatgctcgggcagtggctggagcctggtggggtagtcaagcccgctccctctctcctttctgtcctgagcttaggctctttcccccaggaagtaatgcatgccttgagacagacatggcacaccacctgcttcgtctgtgcggcctgcaagaagccttttgggaacagcctcttccacatggaagacggggagccctactgcgagaaaggtaggaacacttcgatggcatgtggggaggccccacagcctgggagaaaggggcaggcacagggaactaactcctgcctaatccattcacatccgaccacccagaggcctttatttctggaagaaacctttgtttttgcttttaatggcagaatcatgctaatatcacacaaaggaagttaactatctcccctgcccatatggttgcagctttggggagagtgaggtgcagagtctatagcttattttatgcatcaaatatgtggatctggttaggtgaggtggctcacaccttaatcccagcactttgggaggccgagacagaagaattgcttgagcccaggagtttgacaccagcaacatagcaagacccagtctctacaaaaaatataaacattagccaggtgtggtggcgcgtgcctgtagtctcagctacgcaggaggctgaagtgggagggtcgcttgagtccaggagttcgaggctgcagtaacctgtgatagcaccactgtattcagcctaggcaacagagtaagatcctgtatctcaaaaaaaaaaaaaaatgtagatcacaagttggcatcttatgaccactgggaaacctttcaggttattttgatttggagaccacaaggtctagtctgaaaaggccttggctgtggactttgtccttcattctattcctggttccactttgggctgctttgtaaacctgagcaagttactaaccttctctgagccttactttcctcgtctgtaaacacctgccttacagagctgtggtgaggattaaaccagagaaggcgtgtagagcatcaaatatgcgagaccccttcctctgcccctgtgatatttatcagactttgatgttcctgcagattcctgtaatctcacggagtgaattcagagtttctctgtacccccaaaatgctatatgttatcttaaaatgctaagtaaattattgtaaattcaagagacaaagcacttcattagataggtggaagtcagtcactcatttattcagaggcttcccccttcagaaaggatttgaagcaggttccagaaaaggtaacacagacatgaaggctaagacagtagaaccagaaaatcagaggcgggaaaagcaggcatgctgattatgaagaataacagagctgcagggactaactgggtagcaaatttgagggcaaaaagagaaacacagtaagttagtttactttaaaatcagaaaggagaaaacattcagttcctcaagggaaaaagcaaaacaaaataaaacttctttcccctgactgtaaattagaaaataaacgttttggctgggcgcggtggctcacgcctgtaatcccagcactttgagaggccaaggcaggcgaatcacctgaggtcaggagttcaagaccagcctggccaaaatggtgaaaccccatctctacaaaaatacgaaaattagccgagcatgatggcgggcgtctgtaatcccagctactcgggaggctgaggttgaagaatcgcttgaacccgggaggcagaggttgcagtgagctgagatactgccgttgcactccagcctgggcaacacagtaagactccatctgaaaaaaaaaagaaagaaagaaaagaaacgtcttgggttcttgtactagtgaatgcccttcccagctctgaagttaactgaatgacctgaaacaagtcacttactctgtgcctcagtttctatatctgtaaaagggagaagataataccagacctttcctttctcatgagcatatgatattgatcggtagttaaagaaagagctgttatgcttatacaacttgctgttattcttctactaaaagcattataacttctattatttgagataagccgcaatttgtgtctgaggcttttgaaagaatgatagatttccattatcactgctgcccctcatcatagcaactcccccgaaaagattctcaaaaatgatgttttgagtaagaagatccaggaagaagacggtctagtgttaagagaagacagtgaggaagcagatttaccttcagacctaggtaactggagagacccagttgatcctcccacctcagcctgtagatggaactttagacatccgctaccatgcctagctaattttcatcattttttgtagagatgaggtcttgctatgttgcccaggctggtcttgaaatccagggctcaagcaatcctcctgccttggcctcctgaagtgctgggattacaggcatgagccaccgtgcctatttttgattctgttctatttttgattttgtaaggaacctcatactgttttccataacggctgcactgtgttacaaacccattaacagagaataaaggttccaatttctccgcagccttgcaaacacttgttattttctgttttttaaaaaatagtagctatcctaacgggtatgaggtgaaacttcatttttacgtctcgtcattttaatcaacaatttggaagaagacacagaagggagtcctgtcaaatctgcagattgagccagaatgatagggtctaggctgaaaaatgcttcagctggctgcaaagataagctgacatctgcatataaagaagagagataggtgggtcagcccttcacagatgaacctgcacccgagcagttcccaaacctggcatcatggtcacctagggaacttaacaaactagagagaaaatagattgtttcagacctacctcagacccacagaagcagcatttcgtagggtgccccaccctacccaggtgtttcagttaggtgtgggaatcagaagtgtttctcaaagtgtggtcccaacaccagcagcaacatcacctgagaacttgttagaaatgcagatcttcaggccccaccccagatctggtgaatcagaaactctggaggggagcctggcacgctgtgtttcaacaaaccctccatgtgcttctgatgtttgggaaccattgctctagaaaagtaccaagccccttttcaacacagagcacctgcaatttgatggacagaaatccttttacaatagcaataaaatccattaaatgtgagggtagtaattcagcttgggacaagagagagtcaaagaaaattagaaagacttaaagggagaaataaaggaaggaataaatatatgaggagctagattatactccttgtggaaaaggcccatgcacagactttgttcggtaccagcaatgttctccttttgcagaaataacttttgcagaagttgtgaagaaaaataccaacttaaacaaaaatgtgttagtatcagacccatgctaccaaattttaaaacaaagcgataattctccaaatcatatggaatcaaatttaaaacagaaaaatgaatcagtgggcaagacaaggcattccagaggtaaattcaagcctttgttttgttttgttttgtttttgagacggagtctcgctctgttgcccaggctggagtgcagtggcgcgatcttggctcactgcaagctccgcctctggggttcatgcaattctcctgcctcagcctcccaagtagctgggactacaggctcccaccactgcacccagctaattttttgtatttttggtagagacagggtttcaccatgttagccaggatggtctcgatctcctgatctcgtgatccgcccaccttggcctcccaaagtgctgggattacaggcgtgagccaccgtgcctggccttttttttttttttttttttttttgagacagagtcttgctctgtcacccaggctggagtacagtggcatgctatcttgactcactgcaacctccgccttctgggttcaagcaattctctgtctcagcctcccaagtagctgggattacaggctcccaccaacacgcctggctaatttttatattattagtagagatgggggatttcaccatcttggccaggctggtcttgaactcctgacctcgtgatctacctgcctcgacctcccaaagtgctgggattacaggcgtgagccaccgcacctggccaattcaagccactttaatagcttaatctgtgaaaagccagtaagagaaggaatcactatttaattaggttgtttgaaccatttaatttaatttttatatttatttaaatatggaacacagcccagcttggtggctcacgcctgtaatcatagtactttaggaggccaaggcaggaggaccccttgagcccaggagttcaagaacagcttggacaatatagggagaccccatctctaaaacaaaaaaaaattaaagtagccgaccgtggtggtgcacacctgtggtcccagctgctcaggagcctgaggtgggaggatggtttgagcccaggaagttgaggttgcagtgaactgtgaccacatcattgcactccatcctgtgtgacagagcaagactcaatctaaaaaaaaaaaaaaaaaaaaaaaaaaggagatgatggatgaatggataggatgcatggataaatggaggagggaaggccagggaaagccttcagcaaggccatctcatcactcttggttggggtatgtagggcatgaagacttccctgaaggacagcctagcacaaaggattgcagagattctctcaggtacagaaagtggggatggtttttcaagcccagggcctggtttgcacagaggcatggaggtgtaagagaaagtccagggcaccatgagaccacctgggagtgatgagaaagaagtcgtaagtgggtgcagggcttgtcctcaggtggagacgggtcagcccataccagatagtagtaagttcttgcagagcacagagtgaactgcaacctgggcggtaactttctaaaggaagcagaacgatgttttcttagctctggcaaggcaatgcatttctgcctactaaagaaattaagtgttccatcagagaagattgatggactgggatacataagagcatttgcatgacaagctacaattaagcacaaaaggggaagctatatattggaaaacacatgcaagagataagtgtaactgatcaaagctcaatgccatgctgataaggagctggagacagcgtaaagccatagaaggaggatgaacattggagtccatcaggactggggctactccttatgacttctgtgatggaacctctccagtcagtttcctcccctttaaaattggaatactaggctgggcgcggtggctcatgcctgtaatcccagcactttgggaggccgaggcaggtggatcacttgaggtcaggagttcaagaccagcctggccaaaatggtgaaaccccgtctctactgaaaatacaaaaattagccaggcgtggtggcacatgcctgcaatcccagctacttgggaggctgaggtgggagaactgcttgaaccctgggaggcagaggttgcagtgagctgagattgtgccactgcactccacctgggtgacagagtgagagtccacctcaaaaaataaataggctgggcgcggtggctcacgcctgtaatcccagaactttgggaggcagaggcaggtggatcacagggtcaagagatcgagaccatcctggccaacatggtgaagccccatctctactaaaaataaaaaaatatagctgggtgtggtggcgcgtgcctgccctcccagctacttgggaggctgaggcaggagaattgcttgaacccaggaggcggaggttgcagtgagccgacatcatgccactgcactccatcctggtgacagagtgagactccgtcgcaaaaaaaaataaaaataaaaaataaataaataaataaataaaataaatagataaataaatagggaatattatctcttcacagagatgtcatgaggattaaacaggaggcataatggcactcaaatcattgttcctttccctctttgcatcagttatgaagactttcaaaataagagccaacatttttgagtgtttgtgccaaatacttcacttacattatcttatttaatccactcaaaaccccatgagttcggtacaataattattcccattatatagatgagaaggttgaggccttgagaagttacgccacttgccccaggtttgaacatttcttaatagagttgggatttgaacccagctcttcctttattcagagtccaattttgtaacccccatggcacactggcactcagtaagacgtggtctaagacaatgaatggacatactatccacaagaagaacaggaaatcacttaagaaaaagccaactgtggaagagttatggaggaatgcgtacacttctcaggagggatgaaggctttgtaaacgggatggagcttttctagaataatctagagatgttctacagtcagtgtggtagaactgtagcccctttgggcctagagaggacagctgccctggtgaaggagcacagaacctgacccactgtgcttcagctgtgggatgctggctgggcccttcacctctttgagtctcaattttctcatccacaaaacaaaacaaaaagataataatagttcaatttctgagggattttgtgatgatcagtttcattcattgatgaactgattgattggttaatgcattcattccctatatatgttttggatattgactgtgtgtcaggcattgtgctgggagtgcaaagaaagctaagatgtagtccctgacattgacatacttgtaaataacaccatccatgtgaaaatgcttggtaaattgcaaagcatcatatcaataatatttaatagcattatctccttggttgggggtagggaaggaggaggaggacatgccccaataaagtagttcaaatactgtttatagtagtaaaaacttgttgtcaacacaaatgccccatgacagaagaatggccaagcaaagaaaattctataactcttaaatacgttggacccacattcttccaaactaagcatagatgtttggaaatgtggattgttttctctttggggcttgatccgtttggtctattagaggtgacagaagcagaggagacaatctccctgcagaaggttgatgacaattccagaaagtgtttgcaaatcaaaccagcacaagatggtgtctaagcctgggtctgaacaacatcaatgcaatgattggaaaatggaaaactatcagtcatgtaactgagtatttcatctgtgagatgacaaacaaccaattagatttcaccccctgcttctgcccactgatttggggtttgtcttggctttgggtccccgctgcccccactgggtgcggggtcttcactctgcttttcatttcagactacatcaatctgttcagcaccaagtgccatggctgcgatttccccgtggaggctggcgacaagtttatcgaagccctgggccacacttggcacgacacctgcttcatttgcgcagtatgtctctagcttggggctctggctttctgagaagaggcaggagggaggaagtgggagccagatgaccaacctctacataccttgccacgctagctttctgacatcctgatcatttttaaaagctggcaaacaccatgatgcctcgatacatcacagtcgaacaaagtttcattcctaataattatttataaaccaatgtggctttgttactttccatttcgttaaggacaacagagtgtcccagggtttggcaaaccagcggcttgtctcaccagcagtgttgtcagcgggcaaaagcagcagatgatgcttggctttgagaggggcagttggcttcccatggttatatgtcacttcagatatgatggagtgacttgaaggttttcccctccaaattgttaccccaaacactagattggagctgactaatcctatgaaaagctgagatagggtttctcttggtagcacctttggaaagcaagactgagtaccattttattttcctaagtggtcctttcctgatatatagctgccaggagataagccctggattaactattaactgtgtgctacttatttctgctgaacagccgggtcacttttagtatgagactggcattttccttctgagggttttgggttggggtgggcacatgatggtgagcctacagacatttagactctgaaggagaggtaggaaacagtcatccctgagaaagccccctaatgtcaatctgtcattgcctaatctcgatttgagaatttttttttttttttttttgagatagagtttctgctcttgttgcccaggctggagtacagtggcatgatctcggttcattgcaacctctgcctcctgggttcaagcgattcttctgctttagcctcctgagtagctgggactacaggcacatgccaccatgcctggctaattttgtgtatttttagtagagaggggatttcaccatgttggccagactggtctcaaactcctgacctcaggtgattcacccaccttggcctccccaagttgtgggaatacaggcgtgagccaccacgcctggctgatttgggaaaattaagacacctctactattttttttttaaccagagtgtctcaaggtaaattttggaaatgtatgaaatatctgtacagtttttacttgaataatttttatagacttctgacataggatgaccctagtcataaagtttacggccatatacttttggttccacacttcgcttccataccccgccatctgtgggacacactgtattcactctgtgtgtcggtttgctagggctgtcttgacaaattactgcaaactgatggctcaaacaacagaaatgaatgctttcacagttcaggaggccagaagtcctaaatcaaggtgctgacaggaggccatagtctctctccgagctactagcggttgctagcaatccttggcatttcttggcttgcagctgtgtaactccaatccctgcctccattgtcacaagcctgtctcccctctgtgtgtgtcttcacatgacattctcctctgagtgtgtctgtctctgtgtgggtctcctttttttttttattttttttttgagatggagtttccctcttgttgcccaggctggggtgcaatggcgtgatcacagctcacggcaaactctgccttcttgcacgtgaattttgtggaatacaattcaaccccttaacactctgattttctagctctttgaacagattctctagttgtcttttagggtgttttaaatacatcccctccaaaaagagacaatggtgtaagtatactggctttgggtttgtcccctgcagagtcatagctcccctgtgtcaggcacagcacaggggtctctgaaccttacattcaagccatggcttgtctagtcctgaggcactgcctgcacatctggttacccaacttctggaaggatccaagagacttggggaaggtccaggaagacagtggcacagaaggcctgttttccatgggcaggctgatgagaggtctgtgtcacatgcagagggaatcgtggcaaaggtgagtgtgggtctgcttctgcaagcctcgcaatttcagctgagtcacaacagcaaaagtccaagagagagaccagaagaaggcgtaaagcttggggtggctaaggctgatattacaaataagttccagagagtgaagtccagcctgtgagaggcccatagcactgccctttagaggatcaacatggagatcgttaggtctccctccaaaccagcctgcatgatactcactgctctgtcaacatatagcaaagtggaacatggttcttttgtttttttttttttttgagacaaagtcttgctctgtcgccaggctggagtgcagtggtgcgatcttggctcactgcaacctccacctcccaggttcaagcaattctctgcctcaggctcctgagtagctgggattataggcgcctgccaccacacctggctaatttttgtatttttagtagagacggggtttcaccatcttggccaggctggtcttgaactcctgacctcatgagccacccacctcggcctcccaaagtgctgggattacaggtgtgagccaccacacccagccggaacatggtcttaacattaggaagaaatcttttgattggaaaactttgagggacttgagggatttttttttttttggtcctctttctatcacttcatatttccaaatcacttttgatgagcatgtattttcctgtaacttccaaaaaattagtaagagaaagatctggggtagctctcccagctgatgtgctgttttctaaccagtgagatctcaggatagcacattctttagactaactcagtttaccaaatattcctggcatttgggcagtacaagagtgttccagaacaagtctctaccctgacggaatctagaatcttgaaaggtgaacaaagcaacagatgtgagcaattcaaaagtagaacaggacagtatccctcaagtccaaagcatataaagtgaaggctgggagcctgagaagtgcactgtgggtcagggtgaaagttaagcttctgtctggcgtcgacacttgagttccaatggaaagggtccgaccttagtggaggaaaaatgtcttacccatccctcttttgctctaagtcttgcccttccccactggtgtgggtatcaggaggggatgggcagtaatataacttttgtaggcagacctaggggctgctgcagctggcctagtttattaccctaactctgctgggacttgcagtcagcactgtccatggtcgctacccttttatagccaggccctgatgtcacccagccacagagcctgggggttggaccatccctgttgccccctgtgctgggtgggcagaaggcctcctccactatgaagccaccttgcaccaagaagacactgggcacaactccttatgagggttcccaccctcagccccatctcacctatgagccatctttgaggttctgtccctttctcatttgttggtcttcagtccctggacaccttctctccccagcctgactcatcccaaagttctcacaagcaaccagcattgtcccagtccaggtatggtctcccacccacagctgcagtcattgacaggctgactcattccagagatgcctttctgtcttccctaaagcccattctcaccagttagatcttggatgtccatctttttgcatagtctttaaattgtcaccagcagcttgaggcctccacacgagcctggttatactcagcatcactgcatccacctgggatgttttcaaacacttttgcagctcattggctcccagaacccaattggaagccctgtgtgatcctaggtataacgtccccaactggaccatcagagccttgcacatggggctagcgtggtgcccttttcctctccaactctcttggactgaatacatgcatattgccccaagctcaactcaagggggtgatttctctgtctccatgggggatacctgtatgtggggactccacgtgcactcctcttgatgtcagtgtcctggagatggctcccaattctgccccccagcagggatcttcactgccctctcctaagctgggacccatgccagccaatgtgatttcctggcagactctgacctactggcatattgccaacccagggcccagcttacatactagtagtccagcaaactcagagggctacatctgtacaaacccatgaacccagatcaatttcaagtaaacacagtccctttcttctatggggtaggggaaaaattagcatagaactggagtcttacagacatggacagagattcccagcctacaacttactaggtctgtgacttaaggaagacgtatgggccctctgagccccagttttttcagctgtgaagtgggagaaaggcttacctaccttataaggttttcatgagaattaaatgagctgctgtatatagagtgtctggcatcctgcttggtccatggtagtccccacaaatattaattagttctcttctttctgggatgcctccagcctcagactatatgttgtcatcatggggatatagaatttcatctcttgggctgggcgtggtggctcacgcctgtaatcccagcactttgggaggccaaagcaggtggattgcttggggtcaggagtttgaaaccagcctggccaacatggtgaaaccctgtctctactaaactacaaaaaaaattagctgagtatggtggtgggcgcctgtaatcccagctactagggaggctgaggcaggagaattgcttgaacccgggaggcagaggttgcagtgagctgagatcgcgccactgcactccagcctgggtgacagagtgagactccatctcaaaaaaaaaaaaaagaatttcatctcttttgtttttttgtatatttctctgcatacttttccatatctacctttttttttttttttttgagacggaatctcgctctgtcgcccaggcttgggtacagtggcatgatctcagctcactgaaacctccgtcttccgggttcaagtgattctcctgcctcagcctcctgagtagctgggattaccagtgcgcaccaccacacccggctaatttttgtatttttagtagagacaaggtttcaccatgttggtcaggctgatctcaaactcctgatctcgtggtcctcctgcctcggccttccaaaatgctgggattgcaggcgtgagccaccatgcctggcccatctctctttttaaatggtggcattccattggaaaaatacaccatgaaaatttactgaatcatcttcctattgagagaaattttactagttttcagtttctagttgagcacaggttgttttgttgttctgcagagttgcttctgcaggataaaattctctagcgtggcattactgggttacagggtagtcacatctcaatggttcttgttcaacatggccagattccctatggaacactgagctcactcacatgtctctagcagtgcacgagtaggccttgttcctttttggcattgctgatttttgattgaatactttttttttttttaagctttttggctacaggcatattaggttaaaggtgacaggccattgaggtttttttgttttatttgtcttgctagattaatatgtgtctagtggtatctcagggcagtttttcttgtaatttttttaactaattttcttttctttctttctttttctttttttttttttttggtagagacagaggctcactatgttgcccaggctggtctcaaacacctggcctcaaacgatcctcctgccttggccttccaaagtgtagggattacaggcatcagctactgcgcctggagtcaggggagttttaatttgctttttctttaattattagtgagtacaatcttctctgatgtgtttgttagtttactaatgattttctttagacgtgaatcctctctgtggtatattgacttgtgaacttgtattgactctattcatgctattttagatagcatgaattggtcagcttcatagtgtatattttctctattccattaaatttaattaatttcatttgattttattctgttcttcaggaatcttagtttttatatagtccaactcatgtactctgcttccgtcattaagaattcatagtgggagaaataggctgttgccttttctctagaatgcatggggcaaggctgtttgtttgtttgtttgtttgctttagacagtcttgctatgttgcccaggctggagtgcagtggcacaatcacagctcactgcaacctctgtctcccgggttcaagagattcttctgcctcaacctcccgagtagctgggattacaggcacatggcaacatgcccctggctaatttttgtatttttagtagagatggagtttcgccatgttggccaggctggtcttggactcctgacctcaagtgatctgcctgccttggccttccaaagtgctgggattacaggactgagccaccacgcctggccagggcgttttcttaaaaaagtgattgaaatctgctcatgccctgtgccacgtgggtctcacgcaggtctgttctctgctccaggtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaacaaaaaaacaaaaaaaaaaccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgcaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgtttttttttttgcctgtgtgaattctactttttagcaaaaataaagccccccaaaggatgtgcaaatacagatttttctgtgtaaaatttttcatgtcacatcagaagtagcttacttctatatggccacaaataaaagttggagacaaaacaaaacattctgtgggaataaacacaacttgcttgccctgatgctcaatagcagtgtaatcaccatgtttaaacagacaaggatatgtgaataacacgaatgttctgcatacaaagggaattaccaggcaaataataaaccaaagacctcatctcgcattatatttccataaaggtttgttaacttagctacttggcggtaaaatatttccaattaatttatttctattctgctctaaatggcttcatttctagaaaagttgccatatttcctcttacatcatttgttttcaaataagttcagagtaaagacctctcatagaatttttttttctttttaataatgaagacccttctgagggtactatgtttaacaaaatcaaactcattctttttcaaggtattctgtttctagaaattactgaagagtaaagggaagttgtacataccatatttgattttcagcacctgaatcagacttcgaaagagctgtgcaattacaaacagaaatcacatctcatcattttagtacttcttaaagctataacaattttaaaaatagatgatggagaagaaaaggctcctacactcactcacacacacacacacacacacacacacacacacacacacacacacaaaatactaatagcccagaaatatgaaccaaaaattagaatttggtataattaacttgtacataatttctgcccccctaaggatttgtggacagaataaatattgtttgcttatttgctcattcattctttcaacaaatatttattgagcacctactagtgacatgaacaggcactgctctggacactgacaacacaacagtgagtacagcagacaaaaacttctgctcttgtggagtttactttttttttttttgacttttttttttgagacaaagtctcactctgtcttccaggctggagtgcagtggtgcaatcttggctcactgcaacctccacctcccacattcaagcgattctcctgcctcaacctcctgagtagctggaactacaggtgcctgccaccacatccagctaatttttgtatttttagtagagacaggtttcgccatgttggccacgctggtctcaactcctgacctcaagaaatctacctgccttggcctcccagagtgctgggattacaggagtaagccactgcacccggccaacattctttttttcaaaaaaaagttatttatttttatttattttattaaaaaaaatttttttgaaacagagtcttactctgtcacccaggctagagtgcagtggtgcaatctcagatcactgcaacctccgccttccgggttcaagtgattctagtgcctcagcctcctgagtatctggaattacaggtgtgcaccaccatgcccagctaatttttgtatttttagaaaagacagtgtttcgccatgttggccaggctggtctcaaactcctgacctcaagtgatctgcccgcctcggcctaccaaagtgctgggattataggcatgagccactgcgcctggcctgctttcttgtaaaaacaatttattttataactatgaacttcactgtctgatcctagttaagcctctattaacacacatatgaagggttatctaagaataaagatcatgtgttaatctatctactgagcttgtggaataaatcctgccattaattttgtcaaggcaatcagtgactttctgagccatcggacagaatgtcttcagttcagtgctgtcctctgagcctcaggctcatgtgtccagattttgcctcactgcttcacgtggatgtcccacagccacccaagcccacctacttcacgggctggatggttggccatctgtatgtgcgtctatcctttcttctgatacagaccctgcccctttaggtgcatgattggttcaagaagtgggtttgtgaaccaagccagaacaatcagaattcttcttccctgagactgctaaaaccagatcttggagagagattctcttctcttactggtggctgagctggaagaatgagtccaacaggccctctgttccctcttgtgtgaagaaagtctgtttactctaggagagaaagaagccaacaggcactggaaagcaaagagttgaaatgagagagacggagtgttctgccagtgtgatggcttctggatcttgtcattcccaaggctccacacttatcttttccttttgctcaatttcccctttattctttttttttttttttttttttgagacagagtctcactctgtcacccaggctggagtacagtggcgccatcttggctcaatgcaacctccacctcctgggttcaagcaatactcctgcctcagcctcccaagtagctgggattacagccatgcaccaccacacctggcttatttttgtatttttagtagagatggggtttcaccatgttggccaggctaatctcgaactcctgacctcaagtgatccacccacctcagcttcccaaagtgctgggattacaggcatgagccaccgcacctggccttccctttattcttgacctcgtttaaattgggtttctgtcacttgcaaccaaaagaatctcaactaatacaacatccaatgccaaattcaggatgtgacattctgtcatccatgctatagcttcaagaagtattaaaacaataagatgtgttttctatttgtaattgcacagctctttcaaggtctgattcaggtgctaaaaatcatacatgttatggaaaacttccttttacctttcagtaattcctagaaacagattacctcgaaaaagaatgagtttgattttgttaaacatagtaccctcagaagggtcttcattattaaaaagaaaaaaaaaatgctatgagaggattttaccctaaacttatttgaaaacaaatgatataaaaggaaatatagcaacttttctagaaatgaagtcatttggagtagaacagaaataaactgaaatatttgaccaccaagtagctaagcaaacctttagaaaatataatgcgagacgaggtcttcagtttattatttggctggtaaattccctttgaatgcaaaacatttatgttattcatatatccttgtctgcttaaacaaggtgattaaacttctattgagaaggccttcaaataatccgccatccatgctatcatttctgaacatgcatgctaaataaatgcagaatgcttataattgtaactataatttcaagacaaataccacatgccttctgactgaatctcttccatagaggaattccagggctgccactgacttagttctccatcctcctagccaacctgcttctcctcttgtattctttctttcagtgaattgtaggcaccacccggtcattgaaactaaatatctgggatcatcctagtgtcttctcccatattgctctgacaacaaataaccaccacaggctgcccatgtacttcctgaacctgtcttgaatttgttttctcctctcatcctcaggactcctgcctttaaaaaacatctctcctctgcatcatctcagcagcttcctaactgatctccttgtctccattttgctccgtatccacccccgaatccgttcccattcaggatctctccaaaaataaatctgaccatctaatggacctgcacaacttataaatgtcttctcattatccctcaacagagcccaaactaacctgcatttacaagtcccatatgccaggccgctgtgtctctccagcctcacttctcaaccgcaagtgctaccttctcatgatgtgccatcgtcctggccacagcgggccggtgttcccacctcggtatttccaaaacactcctgtattttcacattatttaaaaactgtctgtttacatagaaataaccatttgggtcgggctcggtggctcatgcctgtaaccccagccctttgggaggccgaggagggtggatcacctgaggtcgggagttcgagattagcctggccaacatagtgaaaccccatctctactaaaatacaaaattagccgggcgtggtggcgcatgcctgtaatcccagctacttgggaggctgaggcaggagaatcacttgaacctgggaggcggaggttgtggtgagctgagattgcaccattgcactccagcctgggcaacaagagcaaaactccatctcaaaaaaaaaaaaaaaacataattgaaataaccaaagaatgccataattgttattgcttagctgagaacaaagtgctgtttttcacaaacaaattctattcaaaaccccaaatattttattaagtaaattcttacagaatacctttccatttgcaaatcagttattccctttatctaactctggttcagagtatagttctcgcctttttccttctgcttgtttaaattcggttgctgtcacttgcaaccaaaagaatctcaactaatacaatgtccaatgctgaattcaggatgggtattatcctgaattcagggtatcctgaaaactatttcaaatagaagcactgggaatgcaggagaatcccagcatttgtggaagaaggatcactgcaaggcatccaatgtgtgcctggggtagaaggaatgccagtggtgatggcaattctatcttgcatgtggtcacctccacatccctgcggagcccctctcatcctacttgtgactttctggtgagctgcaggagagggaagcattgtagaaaagtagatacagattggagaagggcctgactcagcctggaatccagtgttttgtggggccatctttaagaaaaagaatatatttgggaggctgaggtgggtggatcacctgaggtcaggagcccaagaccagcctgaccaatatggtgaaaccctgtctctatgaaaaatacaaaaattagctaagtgtagtggtgtgtgcctgtaatctcagctactcaggaggctgagataggagaactgcttgaacctgggaggtggaggttgcagtgagccaagatcgtgctactacagtccaacctgggtgacagaatgagactccacctcaaaaaaaaaaaaaaaaaaaaaggaaaagaaaagaaaaaaagaatataaaattagctgggcgtggcagcatgcgactgtggtcccagctattctgcaggccagggtgggaggatcgcttgagcccaggagatggaagctgcagtgagctgtgatcacaccactgcactctagcctgggtgacagagtgagaccttgttaaaaaaaaaaaaaaaaaaaaagctggcaggacgcggcggctcacgcctgtaatcccagcactttgggaggccaaggtgggtggatcatgaagtcaggagttcgagaccagcctgaccaacatggtgaaaccccgtctctactaaaaatacaaaaattagccaggcgtggtggcacgcgcctgtaattgcagctactcgggaggctgaggcaggagaattgcccgaacctgggaggcggaggttgcagtgagctgaggttgcaccactacactccagcctaagcgacagagtgagactctgtctcaaaaaaaaaagagaaaaaagaaagacagaaaagaaaaaaaggggttacagtagctgcaaacaccaaatggagtattcatttagaatgaggacaaaatcacaacaaatgagtggagtcccagaactctaggtcactttcttctaaagcctacttaggcaagttatcagaaaagcttacataacagtgttccctgggctgggcgtggtggctcacacctgtaatcccagcactttgggaggctgaggtgggtggatcacctgaggtcaggagttcgagaccatcctggccaacatggtgaaaccccatctctactaagaatacaaaaattagccaggtgtggtggtgcatgcctgtaatcccagctacttgggaggctgaggcaggagaatcgcttggacccaggaggcagaggttgcagtaaggtgagattgcaccattgcagttcagcatgggcaacaagagtgaaacgtcatctcaaaaaaaaaaaaaaaagttccctgattgcaaactagctttccctctcaacctagaatattccagcaactcttagcacccatgggggtctttggaagtgagggaggagccttgaagtttaagctgcattagtttcttggtaaagctactctagactcaggccaatagaataaaagacacagccattttgggatcctgattccctggttcatgctctatgttaggaattggcaacatttgtccaggactgttcctggaaccagggccaagacatgccctggaattgggaggggaaatcagattactgagtgaggcaaggctggaaatggctctgcagctccctcctcctaagaagcggttacctctctccactttctagttgaattatccctataagcccaggtttaatgggaaggtaacccaaagagtaagcaagctgttgaatggtatggtaatatgaggttgcgagtttaggaggaaagatggggtgttgcagaagccccaggcagtggctcagacctgagccatagataccaggtccttttttagttgcttggaatgatttaaatgaccaggataatgtcatagtttgtaggttaataaccagaatgtgactttagaggaaaggaaacaagttttcttattgtttgcgtgtgtgtgtgcatgcaccttctatgcttatgcacagtgcttggcactttatgtatcttttctcattgaacttcacaactctaccaggtaaggaagccaaggtttagataggtaaaatacatctccccaaaatacctctctccactaggcacttgatgtgaagtcctttcctttgtggaaatactatattcatcagaagcactgggaggaagacagagttgagtttagttccacattcattgagcctttactttgagcaaggcctcatgctaagtaactaagtactttattgtgaattcagaggcaaatgaggcacaatccttgcctcacagagctcatagtctggttgaggagataattaagttatgcataatttcactatcataaggcaataaacgtttcttcaactttatataaagcagacctacaagcaaaggacagtaaacacatgtcctctaggagctttctgcaattgtaaaatttctcttacaatctaatattttagctttaaaaatcatgctctgttttaagttattattattaaaaaaaaaaaagatgccctggacgagatgctctataacctttttctttttttttttttttttttcttttttgagacggtgtctggatctgtcgcccaggctggagtgcagtggcgtgctctcagctcactgcaacctccacctcccgggttcaagcgattctcctgcctcagcctcccaagtagctgggactacaggcacccgccaccacgcctggctaatttttttgtatttttagtagagaaagggtttcaccgtgttagccaggatggtctcaatctcctgacctcgtgatccgcccgccttggcctcccaaagtgctgggattacaggcgtgagccacctcgcccggcctgctctataaccttttgtactccacattcagtgttaggtgcctcggtttgagaagccgaaggccagataagtgctacaggacagctcagcaggccgctaacccggcctgggagtgggccgccaaggttttctagagaaggaaattccagagctaaggctggaatgaagaactggagcccagcccaagctgaagcagaactcatatactaattactgaactgcattgggctgtatttgaagtaaggctcatttagagttttacagtttgttttctctccccttcaacacaaacactaatggaccaatcactttctagaaggaaaaagaaagtaactaaaattcattgagtgctgactctatggcaatcactttgcatatatctcagttaattctgacatctgtcccatgagattggtattatttattcccattttatagatgaagaaactgggagtctaagaggctgacaaactctgcccaaggtaaaaaactgggaagtacagccaggattctgattgcaaagttcgtgttcttcccaccacatcatgtggctaagcctgtttctcaagagtctctttagtggatatgcagaagcagttaagaaaatagtgggattggcctcaagtttcaaggaagaaaaaactctttggccatctcttttggtcaaagaaagttctggaaaggggtttctgggctactcctctggctggcattgcagcgccctacctcaccaagccagctctgctgaatctggacttggggaagtgagagttcacaggacatcctctgggagtgtccgctgaggtctgctttatacagtttatactttgctgtaaacagctcgctgttcccaattaaacctgtacgatcatgtgtgaacttttaggaaatgaggacttctttttatggttctcttctcagtgttaaaaccagagcccttgtcagtccacgagcctccttaaactgttgggccttgactctgagactccggaatgtagtccagaaatgcttggatcctggcacaacacccagggaatgcctaagtgagaggatggctccaggtctgcagccatgtcttccagaaggatgttctctgattcttctcagcagggttctagggcatcccaaacacaggtctctgatgctattcacgctaggatagggaatacagatctctcaactaaaattgctgcctgaagtaatttttgaagaaacagtatttcaaaatgactaccctctctcttagagaaagagttggttgaaaccactttaatttgaaattgggtaataaagaaatgaatgggtttagctctctttaatgttgacaaattaagaaaggaatatgtgcttattaaataaaatatgaaaaacacacataggcagaaagaagaaaaaaaagtgaccatagtcctactactgggagacaaccgctacttagcattttggctagtttctaccattaaaaaaattgttttttttgtttttgtttttgtttttttttgagagggagtctcgctctgtcgcccaggctggagtgcagtggtgcagtcttggctcactgcaacctctgcctcccaggttcaagcaattctcctgcctcccgagtagctgggactgcaggtgcatgccaccatgcccagctaatttttatatttttagtagagagggggttgcaccatgttggccaggatggtctcgatctcctgacctcgtgatccacctgcctcggcctcccaaagtgctgggattacaggcgtgaggcaccatgcccagacaaaaaatttgtttttttaaaagaatcggccggatgcagtggctcacgtctgtaatctcagtactttgggaggctgagacaggtggatcacctgagatcaggagtcgagaccagcctggccaacatggcgaaaccccatctctactaaaaatacaaaattagctgggcgtggtggtgtgtgcctataatccttgctactcgggaggctgaggcaggagaatcgcttgaaccctggagacagaggttgcagtgagccaaggtcgggacactgcactccagcctgggtgacagtgagactccatctcaaaaaacaaacaaaaaaatcgtagtaagaacacttaatataaacggcaactttatatccattgaatagcaaccccgatttctggtgctctgcatgtttagagaaacttctctagtagcaaactacagaaaagatccctgaatgtgtgggctttctaccatttatttttaacagcgagaacaaaggcatcaattcagccaatggtttcagaacctgttcttcttttttttttttctcactccatcatccagactggagtgcagtggtgccaacatggctcactgcagcctccacctctctggctccagcgatcctcccacctcagcctcctcagtagttgggactacaggtgtgtgccaccatgcctggctaatttttagtattttttgtagagaaggggtccgcctatgttgcgcaggcttgtctcaaactcctgggctcaagcaatcctccctccttagcctcctgaatagctgggactacaggtgtgtgccaccatgcccagctaatttttggtattttttgtaaagaaggggtctccctatgtcacctaggctggtctcaaactcctggctcaagcaatccgcctgccttagcttcccaaaatgctgggattacaggtgtgagccaccatgcccagcccattttcttttttaaggtggcattttttttagttttaatttttgtggatatatatatatatatattttaaatggggtacatattttgatacaggcatgcagttataataatcacatcacggaagctgggatatccaccccacaagcatttatcctttgtgttacaaacaatccaattctactcttttggttgtttagatgcttcattttctttgttcctttttttttttttgagacagaatctcactctgttgcccaggctggagtgcagtggcgcgatcttggctcactgcaacctctgcctcctgggttcaagagattctcttgcctcagcctctcaagtagctgggattacaggcgtgcgtcaccatgcccagccaatttttatatttttagtagagacggggtttcaccatgtcggccaggttggtcttgaactcctgacctcaggtgatctgcccaccttggcctcccaaagcgttgggattacaggcgtgagccactgcacttagctgagatgctgcattttcaatgccaacccctcaatccctgcccattgtgtgcactgagaccatcaagtgatttttttatatatccttcatgtagacctgcactggctagtacatacaatagctgcttggcatgtgtgactgtgtaaattctaaattagttaaaaataaataaaaatcaaaattcagtttctctgtttagccatatcaaatgctcaataaccacatgagattaggggctactgtgttggaacagggaagatacaggacattttcattttcactgaaagttctattagacagtgctggtgtagattctgacctgctcagctcagccttaagaacaaagtcttgagcctagcacggtggctcacgcctgtaatcccagcattttgggaggctgaggtgggaggatcacttaaacccaggattcgagatcagactgggcaatacagggaggccctgtctctacaaaaatacaaaaaaatcagctgaatgtggcagtatgcacctgtagtcccagctacctgggagactgaggtgggaggattgcttgagcccaggaggttgaggctgcagtgagctgtgatcacaccactgcactccagcctgggtgacagacagcaagactctgtctttaaaaaaaaaaaaaaaaaaaaaaaaaaaaaaaaaaaaaaaagatagcattttttacctcaaataatgacagaacgcagaatatttctcagcaataagaaaagccaccccaagaagcagcaaagagatgggctcacagtctctgaaaaggaagtcagtcattagccaccttctgacatcctagcaattagctggtcttgggagaagagcaggtatctccagagaggtgccaaataaataggataagagactataaaaatgaaaagccttttggcctttcatcacaggataatccaatgcatgcgaattaatggtgaaaggctcagtaatagcctttgtgaggaaataggagcagtgtagcaggatatcctttttccgcactaaagcacccaattctttcaattttatatacagcggaagcaattaattgtactagaaagaaatccacagctggcttttcctgatggcctcataagcaacaagcactattgttcagtttccgggacagatgtaaagtcattctattgcactgctgagatttttctgaatgtttagtttgacttctccaaagataacttatgtgttaacatctaaaatttgattcgtcttgtcatcacacattttcagtataagcaactgtcaaaaagttaatttttattgtgctattgcactccagcctgggcaacaagagtgaaactccatctcaaaaaaaaaaaaaaagttaatttttgatttgtaatataatccagcacgtgacttgatgctggtattttttccaaacgttatgtgactgaatcatgttattcacttttgtttgttttacatgtttacatgcagttgaactgcactgcctctgcttttgtggtatcatccacagtgtggctattcaggaatcaggcataacaagattatacatcaaaaactcagaaatttaacatttcaaatgctggcctgtatggcattgcttcaccttctagatgcattaaaatacaccatatttcattaattctcagatgcacattttttttgacatttgaaactttctggaattgcgatatcttaattaacgtgtcagggtttaactggcaaggtttttcttccttagttgtacataaaataatgatggatcttataatcaacagtatccatgctgttctttgggtggaaaaaacccacaacgaaacagtaccctagttttgatgacatatggtatacatagttaaaatctcatgagtatgatgtgttattgcaagtgtaacaacagaacaactctttatttattttttctgagacatggtctccctctgttgcccaggttggagtgcagtggcatgatcacagctcactgcaacctctgccttctgggcttaaggggtcctcttgcctcagcctcccgagtagctgggatgacaggcaagtgctaccatgcctggctaatttttgtaatttttatagagatggggttttgccatgttgccccggctggtctggaactcctggactcaagcgatctgcctgccttggcctcccaaagtgctaggattacaggggtgagccactgtgcctggcctagaataactctttttaccaagaaaaatattcacgtcaatcaaataaataaaaactttaattacatatcttatatgggattctaactgacttcattctgacaaatatacaatttgccactttcatttttctctctatcaatcaaccagttcttttaaataatatctactcttttttttttttggtgctgaaacccacagtcgaaaatatctacttttctgattataaaagtaacattgggccgggtacagtggctcacgcctgtaatctcagcactttgagaggccaaggcgggcggatcatgaggtcaggagttcaagatcagcctggccaacatggtgaaaccccgtctctactaaaaatacaaaaattagctgggtgtggtggcgcacacctgtagtcccagctactcaggaggctgaggcaggagaatcacttgaactcgggaggcagaggttgcagtgagccaagatcatatcattgcactccagcctgggcgacagagcagactctcaaaaaaaaaaaaaaaaaaaaaaaagtaacgtataacattgtccattgtgggggagataaagcttatggaagaaaataataaccatccattaggccaccacagaacactgccaacgttttctctttatttcaggataatctatttctttataaacacacatatttaataatacaaaattaacaaatgcttaaatatatcttgtcaaatgtcctgaaaggtatataatgttacacaataaaaaagcgggttctttaagcaagccagggaccagcctccccattgccactggagtagaattttctggtgttcgacaggatcacgtgcagatgttgcaatgcataattccagggagcaccattcgtgtcaggcaggttgcgaatggcacccccttaaagttgtgcaacctagcaaccctggtgctcagtaccgtgaccatagcgacagtggtacatacgcaggggagatagacaggagggaggatgcaacagcacagcagatgcatcaaggagtttgcaactacccaccaaccttcaaaacaatggattcgcagaagcaaggattcaataactggtaagctccagtggcctgggactgcttttttgatactacgtgtattttggtactccctaaactgtctccctcaggctgagaggcccctatttatgttgaagaacaaaggtatgaaaacttatttgtgagaaagacataagaacagctaagctatgtggaaagtcagtgatgtagaccattgagagaaaagcctaaggagatgaggatggagtagtcaaagatgacttcttggaagaggtggtactcaggcagtatagggaggagaatggcattaaatggagaatgaatatggtccattcttcagaaagtagtgagaccagtctaacgaaatgttactctatagcagtgttttcagatttaatgggactggtgtttcacaatagaaatctaaacaactgggcaacattagttgaaagagggaatgaccaattaggaggagagctagcagcattcaggatcggaggaagaggggctttaaggtaggtagcaaactaaatggaaactaatctgcattttaaaataaacactgacaagtattggttactggttatatatatgactatgtatgcctttgaaataataaaggaagttgttttaaagtttatttattgagaacaagttgttagatgatagttctgttattatgatgtacaggatttgttagtagactctcattccaacaagataagtgctttatcattaatcctcaaaaatatggaaaaacaaaacaaaacaaaacacctaaccctgccttggctaatagaaataaaaagaaatgcgccagggcaaactaccagtagagaacaaaattaagtatgtcattcatttaataaatacttactgactacctactggtgtgccaagcagcacactggatacaatggagtgagaatgagacagttcccattctctgaacttttgagtccagcacagggtcaggtactttcaacatatccgatgggtaaactagtatgcctggtcacactggtgacaccacaccacatctaggaatacatcccaattaccatgtaagccatggacagtaggcacagtatggtgttcatgaatctgcactcctgatccagattttatctccccagttatctcagcttgaatcttttatcatcgcaccttgccttccttttactagtcattcccaaggtaatcatattcagctccacatgctggatttctggactactagctccaaaggaattcttgagtagaatcagtgtttagggatactaagaagaatcagacatgggtcttttcatttttgaatgtatgtatgggttttttgtgtgtatacacacaaacatatgtacatgcatacgtacatatatgtacatatgtgtacatgcatacttacatatgcacacatatgcacgcatacacatgtgcacatatgcgtgcgcacatgcacatgtgcgcacatacgcatatatgcacgtgtgcacatacgcatatgcgcacgtgtgcgcacatacgcatatgcgcacatatgtgtgcacacatacgcatatgcgcacatatgtgtgcacacatacgcatatgcgcacatatgtgtgcacacatatgcatatttgtgtgtacatatatacatatatgcatatacttacatatgtacacaaacacctacacacacacacaaagttcagactagaaatctatttgaattatattcaatagattatatacacacacacccctattacacttggattaatttttagccagaaaaaaatatatatatagcttttttttttttgaaacagagtgtcgctctgttgcccgggctggagtgcaatggcgagatctgggctcactgcgacaagcgattctcctgcctcagcctcccaagtagctgggactacaggtgcctgctgccacatccagctaatttttgtatttttagtagacacagggtttcaccatgttggccaggctggtcttgaactcctgacctcaaatgatccacccaccttggcctcccaaagtgcttgggattactagcataagccaccacgcccagccaaaattacatataatacacctttaatatgtacttagtgtatgtccagagcatatatattatatatagttttcatctggttaaaaaataatccaagtgcaataaaccaggtgctgtgaggatagggaaaagcagggcagtgagctgcagcaggacagggaaggccaagatctactgtgggctgcgtgggagttggggtagggaggccccagctcccggtgctcggtgggaggaaccatagtcctctaggcagtgcctgatagccagagagtagtgagcaaacaacaggtggtagtccaggagcgcagtggggatggggacatccagcctgaggtaatgggggaagggaggcccaacagatagatagaatacagatacagggagcctagaaacaaagagctggaggcaattaagtgatgccaccaacaatacctacaactgcccagcagtctgggtgcagggatgcagctaagtccaaacaacaagcagagaaattccaggtcctggcaagctaacaggtcagggtttcagacacaagagaagggctgtcagttcttagaaaggggcgaggcagtgggaggctgagtcttgagcttgggaccaaagctctgataattcttcctgcctcaaggcctaggaaagatcaggttctatggtaaagggtgtacggatagtagggaaaggaggaatacagaggccacggactaggtaggaccaagtgagagcagcaatatcctccatcatctatctttcaatcatagtagccagtgctttgaggcaaagataaattaaaatggagctaagggagaaggagcaagttgtttagaagtaaacaaaagaagtaaaacactgtaccaccacaatgaaaatgaattcaggtttttaaacttcctctattttgtgcactgaattatatacatccatcttattcttaaccacagtttctgtttcagtttagtccttctaagccatgatggggtactactaaccaaaaaaaaaaaaaaaaaaaaaaaagatgtagtagtgtccatgctgaaaaatgaagctgtttattctccctaacacctacccatttaatattgggtttgaagccaacctaaagggtcaccctaccaatggcattccttcactcgtgcctccttactggcctctaacttatcatcagacccagagacttcgtgctgccttttgccttataagatctttacaacatgaaaatgactttgaatggattagcttggattaatctattcaccttggatccctgaaggcagaagtcccatttcactgaagaggatgtgatccacagctttcccagccaaccttcactctttccaagatagccatgccaccctctaacactaaaagggtcttggtgacaaggtttagaaatgcctagaggatatgtatgcttatttctcttctctcatttaacaaatattcacttgccaggcactaggctctgaggagagagttgagaatagattgacaaagtcaagctggcctgtagtcccagctacttgggcggctgaggggggaggatcacgtgagcccaggagttccaggttacagtgaactatgactatgccgctgcactccagcctgggtgacaaagtgagaacctgtctctaaaaaaagagagactgacaaagtcttttgctcatggagtttatattctagtggagcagaggggctcagaccacaaacaaataactaaatgcacgatgtaattaatgaatgctgctttgggcatgtaacaactacctctcttgtgacctacctggacagaagaaaagaccatttccagcctattctagtaacccacttaaaggaataccaacacattacggaatgttaactgtggatcccgagatgttgcttttgagtttgggggccagaacacacgtgtccagatgtctccctgggcagacagaccggagaaacgggctggcatgcataaacatgccagtagccagggagaacagcatgccccactagctgctggtagccagggcgctgaggattgaagcctgggtactagctgggccttatcaaaggagagcgaaaaattcctgaagatttgaaaaggagagtcttttgcagagaagcaaacatatcacgacttaaaatttgatgcttcaattttgctctcatttctacagtggcagataacacaagccagggaatactcatttgtacatttcagaaacttgatgtactaaggttcccacctgagattgttgtctattttatagaccaattcatatgtctaaaaatccaactagactataaagagcataataacacgcttgccatggttttctctgccgacacattgctcagcatacgtcaatgagagctttgaccaatcaatgtgaatctccttaagcaaaaggcccatcttttcctttagaactaaagctggggctgggcgcagtggctcacgcttgtaatcccagcactttgggaggccgaggcgggaggatcacgaggtcaggagatcgagaacacctattaacacggtgacaccccgtctgtactaaaaatacaaaaagttagccgggcgtggtggcgggcgcctgtagtcccagctgctcaggaggctgaggcaggagaatggcgtgaacccaggaggcggagcttgcagtgagccgagatggcgccactgcacttcagcctgggcgacagagcgagactccgtctcaaaaaaaaaagaacaaaaaaaccccaaaaaacaaaaaaactaaaactgggtattatgaaggaaacttgagaaagaaaagtgaccaattttagttgatgcaagtaatctcacgtatcctcttcttcctgcatagcaagatactacaacccatgactgtcaaacctgagacagctgaagagcccagaaaaaaagattagggaagaaaacagaattgaaaaataattcagaatgacagaggctatctgcagcattaagggcaaaggcgggtaaaagaagaaaagggagacagaataaaagataaaccaaaaaattgaaacaaaatacacgggaattcaaacatttataccagaatataagggaataccctggaatctaaacacctcttcaggcaagaatgtgtgtcaatacaaatgcctggcacattgttttccttccccctttctttttacccagtttacccagttttaaaagtgattttttaaaatgcacctttaaaagaacatcttttgttaagtgacttaaacttgatacatttcttggattactaaggaggttaaagtcacatttggtgaaaaaggggcctatctcctctttcctcacatacgggtcatcgaatacttttaaaagcattttccaccatgaatgaggggaaatggaagaaaagaggtggtgacaattatttgcattttccaaatggacggaatgagcctccggagggtacacgaggtcaccagcgtgagcccgcggtggagctggaggcgtatttatagctggctgacctcagtcctgttgggccctcgccgctccttatcttatgccgctggaattcgcgggctcgcaggtcacaggagcccgggcgcgccgggcctggcgctcccgaatcgatgagggaagccgctctccccggcagatcctcccggccggggagcctccatcaccctgcctgcgcctcggcacgctggcaaggagcccgggaagagacgccgggagcggtgggtgggcgagaaacaaatgcaatgtgacttatatttttctttgtcgcaactaccacgacctggccatcccccaccttggtgacttggtgccttcccagcgaccttatttcacgccagctgactggcgttcaccgcagtgtgagtgtcggccggaggaggggtccacgcgaaagagcccgcgagagtggggatatccggccccgaaggccggagcgggcgtccagggcgccgatggccgcagcgcccggcagccgtgtccacgctcccctccgccgcgttccatcgcgtgctacctacggcgtctgcgggaagctacccgggcggcagctgtggggctggcttgtggggaggggccggcgggcccgcgcggaggagcagccccgactcccgcccgcaccagcagctcggcgcccccttgccggcggctggccctcctccccggcaactgggcgccgggctccgcgaactcttcgggcgcttccgccgtgcgctcggctcttttcgtgtccggggcggggcggggcaggcgcccgtggtcgggtgcgcgcggcgcgggcgggggccttcccagtgcgcgcgcgccgtgcaaggcccgcggacgcccgcccctcccccaggcccccgcacccgcgccgccccctcccctcctggcaagagtcggcggcggtggcggcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccgggtgagttgggagtgcgcgtgcggaccggaggggctggccgcagcggggaggccagaggggctcgggcgaggctgcagaggcagctgggcgcgcggtggccggagccaggggctgcccggcccggccccggcagctccgcaggcctcggcgcgcgctgggccgggaccgcccagccagagacccacggcaccccgcgccgcgtcccccgccggcccctcttttgtctcccactcgcgggttgcaggccgagtttggggatgcggagtgggcgaaagtcgctccggggacgcttctggaatccttaaatgggaaaggcgctcacctccccgccccggagcggcgaggctgatatttgtgatttggctccggacgctgtggggaggaacaggggagaacaaaatgagtttcgggcgggggtcgagtgagaggagcagccggcccgcccccgagtccccgcgggaaggggccctggcccccgagctcccggagctgcttcacctgttgtcctgcgcggcctccgctccgtggcctggtgattccgtacttcagttttggaaaactttctgctggattgcctggacccttttttctctttccagactcctagtggaaagatttggcaaggaaaaaaaaatgagcttgcgtcagggaagaaaaataatatgctgtgtgttagggtctggcgtttgagcgtggtactctttcatgctctcagatgttttaatttggtcaaactcctgcaggttttctcttttaagcggttaacaaactgttcagagtacatagtatgaacttggcacctgtgttacgtcatttaatccttacaacgattctggtttattgtattcctcattgttttaggggaagaaaccgagtcgcaaagaggttaactaacttgtctaagggagctgggatttgaacccaggaacatcgtattctggcaaacgaattaggaagaaaaaaaaccaaaactgtttgcaaacacttttacgtttaggaacatttttcagttactcttacttgaaattatcgctattttgttgctggagttgaaaacaactactttattgtatttacttgtgagaggagttaaactttgaattagagtgtaacttaatgcgtctcattgttttcagttgttgaaataaagaatgtgaaccagaattatttagatttttaaatttgaagctaaaatatgggcaattctctgatctaggaatggggtgagtgtatgaaaggccgattgaaatgtagaatgcgtttttagtagaaccagactcagttcttgtttaatttttcctccattttccgtggagcccactttaaactttttctactttcttcacttctccccaccctttacagaagaggttgaggcacttagcaggagctccttcattaaattccttctgttactggcttcttaaccttccgtcaaagagggagaatttttttttttttttttgtctttcttattagttaacaccttggggtttttttcctttccttctaattttcctgcttagtggagcgtgagttattttctctgtcgtatttgggttctttaaagtacaaatgttcttaagattttttcagtttacaaaaaccttttcttaagtctgctactccttcaagctgtcttgttgctgcttttccttttcaaatcttattaacattttaaaaagcttgttcgtaataaaagtaacacatggttgttaattgcgaactagcgcaacattgaaattaaaatttagtcattcacaatccatctctagagattgccaagtgtagtctgcttttcctgcctttgcctggttggtggctagccactcatttcttaaccccttgttatctggatttcaccttcacaaggaactataacctaatcaacacatttaactacctttttctaagtcctctccttgagttttctgtaagatttaacatcgacttcacattttcagatgcctctccttgggtttcattcatctatactcgctgtattctaacacagggtccaaggcagtaagatacaacagatccttccctcatggagcttaaagtctagtggggaaatacttattgaaaaataaagtctctagttaaatataattgtgattttaattaaggtgcagaatattataagaacttcaaatggagacctgatctggtgcttgtggtggtgggagaatctgggaaagataccttaaaattgctttgttggaacccaggcagattgtgaaggatgagcaagagttaactattaactagatgaagaggggccttttgtgacattatactgactttgttcctctccgccacttttctgccttctgtttcttctttcctctttaatatgcgttctccaagtttcacttttcagatcacttttctctatgtctctagtcccttagaatgattgttcagacctttctgttggaataattctcaattctttgtttatgtgtcttctgaatcacgtttttttgtttgtttgttttgttttttcttttttattcagttgctttctacatatctgtacctgattgttctgagctgcttttccttagcaaacttgcctctttggtgttctttatttttgttgatgtcataccaaacccaaaccttttcccatttcatcatatcttgtctgtagccaacatctgttgattctgctttatgatattgtaactcttctgctctctattcttgctaactgtggggcaattctgaattcatattggtgtgaaggtagtagtcaaatcataaaacgagttgggcagctttccttctttttctctttttcaggatcattttagactgggattatctgttccttgaaagtttggaagacctcccctatgtgaccatttaggcctagatcttttttctggagaggactttgagtaacacttcaatttctttaatagctgttggtttgtgtcgattttctgattctcatatgaattttaatgtttcacatttttttcaggaatttattttcaaatctagtgttatttggctttcacgtagttctccccccaccaccccgcgactccacccccaccccctaactctaaatcaagttctcatcccacctggactaatgttatgattttcttgccttcacttttctcctttatctaatcttatgtatttctgcctaaattaatctgtaagcccagttcttaccacttcgccactcagaagtttcctaggtcttccattaaatgaaatattttctgtggtatttgcctcagatttacctgtttttttttttttttttttttaataccttattgttttttctttctttctttctttctttctttttttttttttttttttttttgatacagagtctcgcactgtcgcctgggctggagtgcaatggcgtgagctcagctcattgcaacctctgcctcctgggttcaagggattctcctgcctcagcctcccaggtagctgggaccacgcctggctaatttttgtatttttagtagaggtggggttttgccatgttggccaggctggtcttaaactcctgacctcagttgatccgctcgcctcagcctccctgtgctggggttacacaggtgaggcactgtggctggcctttatagcagtttttatacaaatattagtttcactactagtttgcagggtgggtctgtaacggacttttcttgcatattaaaaggaataaatggggaaaggctcctgtctagcctaacagtagctgttgaactgtcctgatctgactattggatcttaggagcagcgaaccatggagagaaaggaaaatgggtttcctatcacactaaattttgaagtaggaaccatttcttttccttttctactttcccaccttttactagtttttaggctttaggatgtctttttaacatcacaaggtccatattgaccaagttggaccaactttttaacacaagattaaatgttgacttgcattgagttatgtccattgtaagatacacagtagtgttacagaccacttaaaatatgcttctagttgtaagaagccattgattgtaaggtgcaccccaattccggagatgctaaaatatgaaaaatggatgcatcttagaattgatgaatagtgtttctctccctaatcaaagctcttggatgtgcctggaaatccccagtagtgttttttgaaaagaacactagttaggggcatagggagatcagatgatcagtagactccatctcagggtggcccctgtggtccctaagccagttcgtatgggcagtttaatatataactaatgagtagacattgaatagatgagtaaattatctttgagtatcttttatttactctgatgttgtagactttgttactcttttatagttttatatttctgatgagccttcctttcttatggcacagatttgttatactgttaaagtctggaacagtggagcttggctcttgatccagctgtatataattggctgttgacttatgaaggaggacaggagtatgctagagatagggataaaatattataatcacatttgcagttagggagattagttacatgttggaaaatcattttgaagaaaggaagactgaagatgttcaaacttgtaggaaggtctttctggcctagcccggattaaacccatttatgcctagtgttccactattggaacgctaagcacgtgggagttatttatatcctgctcaaggtcatcaccaaggtctgattgcaaaaattcaaaaaattgcagcctcaggcataaatgggttaagatggtggcagataattagggcctggaatggataggaggcgataactagcgtggatgagagaaggaatgggattggcaagaacaactcctggatttctagcttggaaagcagggtagatgtgggtgacagatatgaaaaatgaggtgggagagctggtttgtagaagaaaatagtattggatcacatggagtttgagatatctgaaacagccaagtagggatttccacttggcagttgtctatatgggtctggggtttgacagaggtttgtgctggaggtaggcatttgggagtcattgctgtatagattttatattccaacagtgggaattgggtggctctctcaagtgactcttgcttacaagtgacagccctaactcaagttagcttaaaggagggaaaagcttctccccactaacccccatgatattgaaaggtctagaaatagacatggctggacctaagtgctcaaatgatataattaattgaggttgtcttttctgttcttcacttttgtggtctcatttcaggcaggtgcatatatctggcagaggaagacataggttataggttatagaattacaggttataggttatagacctcgtatcgagaactccttgtatggtctagcaaagagcctaaaacagcattgagaattttttttctttctttttgagacggagtcttgctatgtttcccaggctggagtgcagtggtgcgatctgggctcactgcaacctccgcctcctgggttcaagtgattatcctggctcagcttcccgagtagctgggtttaacaggcgcccgccaatacgcctggctcctttttgtatttttagtagagacagggttttgcctcgtgggccaggctggtctcaactcctgacctcaggtgatccttccgccttggcctcccaaagttctgggattacaggtgtgagccactgcgcctggccagtcttgagaaatttcaacttaaggcctgggtagagaagatagacattaaataattatctagttgtagttatgttaagatctacaaaaaggaagtccagggaatgttacaagactgataagggaagctgggctgttcaggatgcgggtactttggaaggctttcctgagaaaggtagcccgcagagtgagaccttaggcaagaaaggacaaggagactgtttttggaagtattcagtagtatttatttatttatttgagacggagtctcactctgtcgcccaggctggagtgcagtggcgtgatcttggctcactgcaacctctacctcccgggttaagcgattctcatgcctcagcctcccaagtagttggggtcacaagcgtgagccaccacgcctggctaatttttgtatttttagtagagacggggtttcgctgtgttggtcaggctgatctcgaactcctgacctcgtgatccgcccacctcggcctcccaaagtgctgggattacaggcatgagccactgcgcccggccagaagtattcggtaaagtgagcagtttttgcagctttttaaaaattttaaaggcaatacatctattgtgggtaatttgggaagtataaaaagccataaagaagcagcggaatgattaagtttcagcttctaattttttataaataatgtctgatactggttttactactgagtacctattcaatcacggatgccacactaacccaatccgaatcttcgtttctttatcttaaaaaatagaaggaacatggtgaactttaagataatttttctgcttaaaaaaagaaaaagaaagaaaatatcttgacttgcagcacagttagctgccgaaattgaaggtcatataatgcttttggtcctaatgacatcactggacttctgacttttggctgaagaatcacgccagccttggcagtccttgcaagtaccaaagggagtatggcttatgcctgcggtgcccttcccgtatcctgctttcttacctccttttttgagcattaatttttttttctttagcctttgggtaaagtatcaaaatgttgagaagatagactctcaattttgaaggtgagaaatctgtaggagacttggatagttgtttttttttttttttttttgagacggagtctcgctctgtcgcccaggctggagtgcagtggcgcatgttggctcactgcaagctctgcctcccgggttcacgccattctcctgcctcagcctcctgagtagctgggaccacaggagcccgccaccacgcctagctaattttttctattttttagtagagacagggtttcaccgtgttagccaggatggtctcaatctcctgacctcgtgatcctcccgcctcagcctcccaaagtgctgggattacaggcgtgagccaccacatctggctgacttggatagttttgatactgttttatgtatattaagatttgtaggtagttttcttactagtaattaaaatgctttgtaatgtatttcaagagtatagggtcttgagtgttttaaatttgtatataagaatgttttagattcctggctaaaagaagctcttgttagaaaatattaaagtaaaggctgttaaattttggtgaggctcttaatgtctgcatttttcaagaatcatttaaaaatgtcatgaaataaaaatatttcagtggtaactgttcagaagtatcttaaatgtataccaaatcaatgaaatataatcgctgggtgacagattattcttccttcattttataatcttttatttaataaaaatgtgggggaaaaattgcatgttgaagttgtacgtgtatattttagcaaaaactgttaatctttctgaagtactgctttggtcatcatccctatttgttaaatatttttccctgttttcttatttgcttacaatagaaaatccagaatatcttggactggtctcctgctctggccaagtcagccttttctgctttgcttcctttcctactattttatcagcctaagtcacgtaaatatccgattcaggtttgggttcagaatccttagacctctactgtccactacaatagatagccactaccacatgtggctgttgaagacttgaactgtggctagtctaagtgtgaattacgtaccagattttgaagatagtaccaaaagatgtaaaatatctcattatgcttttaaaatattggttatatagtgagatgatactgttagggatacattggattaaagaaatatattaaaactgattttggccgggcatggtggctcatgcctgtaatcccagcactgtgggaggattgcttgagcccagcagcttgagaccagcctgggtaacgtggtgagaccttgtctcagttaaaaaaacaaaactgatttcacaggattctttttactttttaaatgtggcaactagaaagtttaaaattacacgtcatattggacagtactgcctttgactttcctttccctggttctttgcccatcagaatgctttaaaatctagtataaatccttggccaggtgctgtggctcacgcctgtaatcccagcactttgggaggccgaggcgggaggatcacgaggtcaggaactcgagaccagcctgaccaacatggtgaaaccccatctccactaaaaatacaaaaattagccgggtgtggtggcacgcctgtaatcccaggtactcaggaggctaagacaggagaatcacttgaacctgggaggtggaggttgcagtgagccgagattgcaccattgcactccagcctgggcgacagagtaagactctgtctcaaaaaaaaaaaaaaaaaaaaaagaatattcctctctctcctatgaagccctcctcagtggtccaagcctcatagttggctctttgctgcatcattatttgaagataatcttttggtatattagatttctttactacaaaccttctcagaacttttaatatgctaatacacatggtgaaactctagtatagtttccctaactacgtattaccatagaactgtgtgttttctgttaacagaagttacacatatttgtggttgaaatttcaaacaatacagaaatgaagtaatgaaagtcttctgtaatcatgcttcacctgtgccccaagattgccactgttgaaagtatagagctagaaaaaattttcttttctgttgccttctttctttttttctgtccccatttcctaaaatggggtcatacgatacatccttatctttaaatttattttcactgaatatatagggggattctttttatgtcagtaaatttcaatttcctcattcttttttttttttttgagggaaggtcttgttctgttgcccaggctgcagtggtgctgtggtgcaaacagctcactgcagcatccaactcctgggctcaagcaatcctcccatctcagcctcctgaatagctgggaccagaggtgcatgctaccatgcccagctaattaaaaaatttttgtgtgtgtggaggtgggatctcaccatgatgcctaggctggtctcgaactcctgggctaaagtgatcctcccacctaggcctcccaaagtgctgagattacaggtgtgaggtgttgtgcgcagccttaatcatctcattctttatagtagttaagcagttattccattttctgattataccttaattttacttaccagtttcgtgttaatgaataattagattatttccatttttttcttttgcattgcaaatatgctgtggtgtttgtacatatcctttgagactgtttttattttatgaaatgaattcttagaaatgcatttactataagagaagccgtgcagattggatggaaagtgccaagccaccctgcaaaatcttcgtaaccattcatattccagccaacagtatttgaatatgttctctcctcccaacataatcatatcagtcttttttttttttttttgagacggagtctcgctctttcacccaggcgggagtgcagtggcgctatctctgctcacagcaagctccgcctcctgggttcatgccattctcctgcctcagcctcccgagtacaggcgcccgccatcacacctggctaatttttttttgtatttttagtggagacggggtttcaccgtgttagccaggatggttttttttttttttttggagaccgagtcttgctctgctgccaggctggagtgcagtggtgccatcctggctcactgcagcctctgcctcccggattcaagtgattctcctgactcagcctccggagtagctcagacaacaggtgcacgtcaccatgtccagctaatttttgtatttttagtagagacagggtttcaccatgttggtcaggatggtcttgatctcgtgacctcgtgatccgcccgccttggcctcccaaagtgctgggattacaggcgtgaggcaccacgcccggccatatcagtctgtttttatctttgccagtttgccagctgaaaaaacattcatgatataaggtttctttgctgttgtatgaatattaaaaaacaaaaaattttaagtttcatttgtcttatactctcaacttgttatacgctcctttgatttttgtgctaaaatatttcgtattgctaacagtacacatgcatgctttgtacaaagtaaatgttcagatatttgtatctgttcatggcaaaggcgtccagaatatgctactgcaacataaaaattatttggaaacctggtggctcatgcttgtaatcccagcactttgggtggcggaggcaggaggatcacttgagcctaggagctctagaccagcctgggcaatatgttgagactctgtctctacaaaaatttaaaaatcaatgagatgtggtggtatgcacttgtagtctcagcaactcaggaagctgaggtggggggatcgcttgagcccaggagttcgagactgcagtgagccatgatcttacactgcactccagcctgagtgacaaagcaagaccctgtctcaaacaaacaaaacatatattttaatctggaaacatttgagaatagcttttttttcctcctgaactcccttgtctgcctaaaactagatcctcccccaaagaactcaattgtcataacttccagttgtcataaatcccttccttgggagttttgcaagcagggaagatggtctcttgtcgctggagagaatttggcaccacacctaaacagacattgttataaactatcctatgtccaactgttgtcctaagggtccatttgtctttcctacatgttacttgttttcctgcaacagcccattgttcttttctagttccagttcccctagtaagatggtacacatgccccaaattcggacagcccccttgggtcacatttttctgtgaattattctacatatgtgaatcaaatctgtcatttctcttgcagatgtgttctttgtcagtttaatttatcagacctcaattactgaacctaagagggtgtaggaagtttttcttctctgacaatggccaaattgatatttttctggctgtaagggcaagggataataataaagtaacgtttttctaagaataaatataaatatcttaaatataaagagcgtgagtaaagtttctttaaagtacattaaaaaaactgttatccaaaatgaaacatttgttaaaagaagtggattatgctattaaagatgtgccccccacccccatgtgtttgttcctatcgtagtaatgctgattgttaatggatggcatagtaactttaattgtgttcacaggcctttgttcttaaaattatgcactcttccctgttttttcttagcattttatcaatttgcatagaagagaaaatgatttgtaacaggtttctctggtcacatcactgaggagagtcaacaaaagaagtcattcaattgaggttaaatctttacacaaagaaggcattaatagcttaaaagaataaagaaatcctgatatggttattgtgacttttccatttatctggttatgaaataactaaaaaggttaattaaatgttggcttatttctaggtttagttatgcatcggtgtgtttattgctttctgtgccttattacactctgcttactaggtttgtgaccttgagccaaagttgttaattactctaagccttcttttctcatatgtgaaacaaggataataatggtcctctctctcagggctactgtgaggactaaatgaatgatgagtgcagttcagtgcttaacactgtgcttgccactgtagtagcttaatgaatgttagtgaagatgagtatttctgagagaaataagcaggacagttctatcttaaaatgcaggtttgaatggcttcacatacagggtccttgaaaattaaatctgatcttgttgctttctaaaagtatgcattattttagcttccatgttaatattcacatttgaatttgcaaaatgcttctgtgtatcatcagtactggcaaattgatataggaaattttgttgcttttcctgctttgtacatcaagaattggaggctaatgaaggttaattttcccaccaatgtcaaacaagttggtgtaaaagagtaaatagatctagagctgaactctgtagttctacctactagggaggctgaggtgagaggatcacttgaggccaggattttgcagctgtaatgcattatgagaataatgtgctatgtaaatagcaactgcgcttcagcgtggacaacatagcgagaccctgtctctaaaaagaaaaaagtaaatagaatcagacttttcctcattcactcagagtggatgattaggacctcaaagttacatataaagtaaagtcaaagactccacatgctaaagaaagccctaggcattagtggccagaatcctttccagggcttattaagatgtggcagaattaggtcacaagttggggggagaaggaattgtgccagaattgtcattgcagctattagtttgcctagcagggagcactgtagtttttcttcccttctccttcccttggagtgtccttcccttagaaacttagtgtggagaggtctaagagaaccattcctggaggttaagaatactagcagaagatggaatggagtatctgattacctaggcagtattaattacgcagcaggctggtttatctgtacctatttgagcaaaggataaggaaaattagaaatcccagtgtggatggaggggtggcagtgaccttcttttagttcaggtgggtaatgcagatgtaaccaggcaccagccttcttgccaggcaggctgtgctggacaggggagcaaaagtagttggaagagggtgagctgaggctgggcaaggtgatgcagacctataatcgcagtactttgggaggccgaggtgggaggatcattgagctcaggagttcgagatcagcctgggcaacatggcgaaaccccgtctctacaaaaagtataaaaattagctaggcgtggtggcgggcgcctgtggtcccagctgctcaggaggctgaggtggcagattggcttgagcccaggaggttgaggctacagtgagctgagatcgtgctactgcacatcagcctaagtgacagtgaggccctgtgtcatattcccagcttcttgggcaactgaggcaggaggactgcctgagcccagaaggttgaggctgcagtgagctatgatcttatcactgcacttcagtctgcgagagagagaccctgtctcaaaaccaaacaaaacaatacaacaaatggagggtgagctgaagcagatcttcaggtgggctgagagcctctagtctcctttgtcatgaaagaaccccacttgtccccagaagaaaagctatcatttgtctgcttgtgatacagacagtgtagtcagtattagccaggaaagtggcaactgagatagctactccagtctctctcctccctcccctattcatcagaccacaccccttcctccaggctagctctcttggactgggtgcacccaatctgaatttgaagagaaaggaggtgattgtaagactgaagattaacgttttaaactgtactttttaataaccaaaagctataggaacttttcaagatctccataagaagtggaaaagggagatttgaccaaccacaattagggatagggatagagaaacaattgtttcttgtgtttgtaccgatttcagaccctttgttaagagccttaagttcccattaccttaagttcccattaaggcctttggacacattaagttcccattaagttcccaccaaggcctttggacaccaaatcccattctctttttctccgtatgaggctgtcacagtactatagatgaccatttgatcttctcagtggcctgtttccaaatgcattctgattctcaatactattttagcattaagtgtatcatttaattttatctcagatttataagctgtatattatatgataacccttttaattggaatattaattcaaatatcttaattcctttttatggaattgttggagtttatcaaaccttggaaacgttaaataacataaaaagcactcaaaaagaaacactaattcaatattttatttttacttagtgtttgagattttgaattttagaaagttttaaattaatattcagctgttattcacatataaaaggtaagtaggttttagtttaaagaatgttgagcaataaaatataagattgagatggattaaatggtatctgacatatttccttactctgaatcgatttaacctttacaagtattctatgatatagttactattatcagttcccttttacatgaggaaactaaggctgcagaggttaagtagcttgtcaagggttgcatagttcctaagtggcagagctgggattcaaacccaggcagtctggattttagagtccatgctcttaaccacataattatattgtcaaatggaggaggagaattttaagatgaggatgtgtactaggcacagagttgacttttaacaattaacctctcttttaatatttaaaacgtggtagagattttccacatttaaattttccacagttaatctttgagattgattgattgattgattgaagcagggtctcacgcattccattccccaggcaggagtgcagtggtgtgaacatggctcactgtagcctcggctgcctgggctcaagcttagatcctcccgccttgacctcccaaagtgctgggattacagctgtgagccactgtgcctggctccaatttatacttttttactttactgattttgtttttcctttgcatcttaaacaatattaaaaggtcagtggcatatagttgtttaaaaaaatatttatccaaaattcttcccacataccttctttaaaaattagtgcttttttttttctcatctctgagatgtatacatgtttaattggcgatggtcagagataggttttttttttttttttttttttgagacagagtctttctctgtcgcccaggctggagtacagtggcacgatcttggctcagtgcaagctccacctcccgggttcacgccattctcctgcctcagcctcctgagtagctgggactacaggcgtcctccaccatgcccggctaatgttttgtatttttagtagagacggggtttcaccgtgttagccaggatggtctcgatctcctgacctcatgatctccccaccttggtctcccaaagtgctgggattacaggcgtgagccaccgcgcccggccagagatagatcttttttcacagctttaccatgagtattactcttaaaataaatgaccttgggtaggtgcttgcataacataattatgttatttgtatcgtttcatagaataaattaaaacctaccctgtgagagaacaagaagaaaaagagagtcagttgaaaatgaaagtgattaagtccatctgtggggcagtttttggagtcagattgagaaatgaaatctgatttttacctgttaatgctgctgaataataataatatggaatattattaaattgcttttgttctcttaacagtcatttaaatgtaattggttatggcatgtagacgtctaaaaatcatcccattcctttaaagtttcttttcaaaacaagtcttttttccctcctgattgcaaaaataatgcttacagaacaaattgaaacacatagaaaagccctgagaagaaagtaaaaatcccctgtatttatactactcaaaggtaacatctataaacattttggtatatatactgtaagtttaaaaaattctacaatgtttctactgtaatttaagaatttgtgcaaataagttgagtaaagctaagttcatcctgagcgtctgaacctggaatataaggaacttgaaatttgtaggggtgggggtatctgaatagaaatagaaagttctgaaaatttggctgtcttattctagttatcttttttttttttttttcctgaatgttcttcctttccttctcagcttttgccacttttaagtttttttttttaatcaagatgtttcacatttgatatgttcttcagtaataatagactaaaatataataagatgtagggaagcagaacctaaactgtaggaggttaaaaaccagatgaaggccaggtgtggtggctcacgcctgtgatcccagcactttgggaggctgaggcgggtggatcacctgaggtcaggagtttgagactagcctagctaacatatagtggaaccctgtctctactaaaaaagtacaaaaattagctgggcatggtggcgggcacctgtaatcccagctacttgggaagctgaggcaagagaatcacttgaacccgggaggtggaggttgcagtgagccgagatcacgccactgcattgcactccagcaacagagcaagactccgtctcagaaagaaaaaaaaaaaaaaaaaaaacacaacaccagatggaaatagaaaatctaaaacctctagcagaatgaagctagaaagaatggaatctaaacactgaaattatacatctgctaggcagctgtgcgttctttatttataggttctgttgtggaaatagcaaaagaaactttgaaagaaaaagatatcttaaatagactaagcatatattcttatcactgtgatatgcacatttttagctgtacagcatgtatttcattctttttttttttttttgagacagagtcttactctgtcgccaggctggagtgaagtggtgcgatctcggctcactgcaacctgtgcctcctgggttcaagcgattctcctgcctcagcctcctgagtagctagaattacaggcgtctgccactacacctggctaatttttgtatttttagtagagacagggtttcaccataatggccaggctggtctcaaactcctgacctcagatgatcgcccgcctcggcctccgaaagtgctgggattacaagcgtgagccaccgcgcccagcctttaattcatctttaaatgaattgtccccattttctaggagttattatcttttctaaaaataacataacttttttggattaaatttagatatcctatttatatcttcagcattgaatcaatattttattaaatatacattaagggagcttcagtgatactaaaagagtgtgatgctgttgtaaatttgccattgctttcctttttgtcaatattcaaggattgtcttggaccatgggccaagcctgaattgtaagaaggaatggtaaagcatggtaacccattaaagggtaaagaaattaaaaaaaaaaaattgtcagagatatactctttaaagggccagattttttttataagactttaaaaagaattgatgattcttattttacacaaagatttttagaggaaagaaaaagtatgcaaaagagaagatgctctttgaagctggccataaccctgctgcaagcaaaatcagacaaggatggaccagaaaaagagaacaatttctattctcacttatcgtgtatttgtaaaatcccaagtaaaacacgagcaaattgaatcaaacagtatattgatactatcggataaagctagcccaagattcaaggatgatttgaccttagggattatattagtgtcatttacactaaataaatctaaggaggaaaacaatacaaccatctcagttaatggtaaaaaatatattaaatgaaattaagtaactctttgtgatagactagttttaagaaaagaaagaaccttcctcaacctgataaagggtaattttctacctggggcgtgtagcaaacccaacgggtaaaatacttcccgtgaaaggaagaacaatactaagttcatttttagtgttctttttagtgctggagaccccagccaatggactaagagaagctgaagcgaaaaagttgtaaatatttgaagggaaggtcagaatgtgtactgtttgtttatgctctttgctaagcatgtaatctacctagaaaagccaagaaaatcgattgacaaactgagaaaactaataaatgagttcagtaagttggctctacacgtggtaaacgaggaaatccatacataggttcctgtacaccagcaatagccgtgtgagaagtactgtcactgtctgttacatctgataaaacctgcctattaatctttggcctgcttgtcagtttcttgtcccagacatgctttgagtcatgaggagagcactccaggagatgaggctttcagtttcctgcttatctcaacacgaaagtcaaatgttgtgaagggtggacacaaggctgatggtttcatgacagccccagagagcaaaattcattccccctgatgcccatctcaccctgctatagaaagtttcattttttggacagcatttcctgagagaatgtatcactgagttttctggagacctgaggtctaatccttagtaatctgcagaaataccaaaggatatactaaggaaaacagaaaaggcattcctctaaaaatagctagttttttttttaatgtaatagcttgcagtaaacaatggcaacaatacagaaaactgctttcctccctactctctttgctctcccctctgtgctgtttccttttccttggtaaccagtgttgttactgtatgtatcttcctaagattttctttccatttacaaaaatgcatatccattttttggtgctttgtacagatggcatcatgcattgtgcattgcagcttgcctttttcacctaacattttctctatctccctccttttcggctgctcaccctggggttcatttccccgcagctctgtctgttcccttggcagtcctctcccactgctctccaactcctgacaccttccattgtctctctttttctatttgccttcttgttcttaaggattcttaaatgttttaagcagcctctgttccccttcttagactaatgtttttaaatgggtaaaatacgtaagacttgtgaaggaaaacaattattttgaaatatagctattaacatttttagatatagtaatacgtttgttcttttattaacttattaaataatccaggggtgagtataacaactgccctaatttttagatgctgatgagcataaataatgctttgagttgcctgcagcaagtagtttgatgagaatatctgatttgtttttattacaaagtcacaggtgttgctaatactactgtgtatcctgcctactctcataagtaaagaaaaattcaaagttcggttagtgaaaataaaaatgtaatctttttcacatctaaggttatgaacctcttgaattttgtgaggccatgggcttctgaataagaacttctgcagttgaaacttggttcacactggaggacactgattgttttttgtagtccactcaagcagtggaattttctgttgcagaccccctttccttgggcctggaggggttatcctttaccccctttgctacttccagatcactctccctcccaccttccttaacatcaaatagaaaacatgatattcaatctcatgatacatcttgtagttttccatggaaccttgactgacttccttctcatttaatgaagattttgtcttatatggctcattttctctagtacttctttattctagttcttgatctcaacatccaggtgggagactcttccactaccttcctggcctcttaatatcttgacttcctgcaaagtttccaccctacctcagctatcatggtcataccccagttctgttatacaataataacaaaaaattataaccccttccataatttcagttctaccctgatcatcacttcccactttactggctcatgccttctagtgccaacaattcttttatctcactgagacttagaacccattgaccctattatctttgcactgttcctcaccatactctctccttatgtccttacccttctctttattcagtttaatttctgttgttggtcatgattgttcagttgcaaatattctcagtacacttgccctcacttgcttcattgcttaatagagaaaccccagtttctctattaagaaccgcagttggttaaatccaactgtgcctactctacacttgtactttttaaaaatgtggtttagaaaaatggatatcaactgggcacggtggctcatgcctgtaatcccagcactttgggaaggcccagacaggaggattacttgaacccaggagtttgagatcggagtggacaacatagtgaaacactgtgtctgcaaaaaaattaaaaagttatttgggcatggtggcatatgcccgtagttccagctacttgggaggctaaagtgggaggatcacttgagcctgatgaggtttaggttgcagtgagctgtcattgcaccactgtactccagtgggtgactgagcctgaccctgtctcaaaagaaaaaaaaaagaacatgtatttaccctcttaacaattattaagtatacatcacagtgttacaatattgttcattattttatacaacagatctctagaactttttttttgttctctgcagttacaagcttttaaaaattttatttttaggccaggcgcagtggctcatgcctgtaatcccagcactttggaaggctgaggcaggtggatcacctgaggttgggagtttgagaccaggctgaccaacatggagaaaccccgtctctactaaaaatacaaaattagccaggcatggtggtgcatgcatgtaatctcatctaccggggatgctgaggcaggagaattgcttgaacccaggaggcagaggttgcagtgagtcaagatggtgccattgcactccagcctgggtaacaagagcgaaactcaaaaaaaaaaaaaaaattaaattgacaaatgtacgtatttagggggtacataatgttgacataaatgtacatatttatggggtatgtagtgatgttttgatacatataatgcatgacaggcttgtccaactcatggctcatgggctacatgtggcccaggatagcttcgaatacagaccaacacaaattcctaaactttcttaaaacatgagattttttttgcaatttttttttttggtagctcatcagctatcattagtggattttcttgttgttgttttatttaatttttttatttaaaaaatacataatttttaatagaaatggggtctcaccatgttgtccaggccattcccaaactcctgagctcaagcagtctgcttgccttggcctcccaaagtgctggattacagatgtgagccaccgtgcctgccctgccgctagtgtattttatgtgtggtccaagacaatttttcttcttccatcgtggcccagggaagccaaaagattggatacccctactgtacagtgatcagatcaggataattagcatatccatcatcttaaacatttataatttctttttgttcggaacgtttgatattctccttctagctatttgaaactgtatattattgttcactatagccttcctaccgtaggataaaggataaagtactagaatttattcctcctgtcttgctgtaattttgtatcctttaacaaatttctccctgtccctccctttcctctacccttcctatcctctgttctgtgttttacttataagttttttagtttccacatgagtgagaacatgtggtgattaactttctgttcctggcttatttcatttaatataatgtcttccagttccatccatattgctgtgaatgagtggattttatttatgtattttctttttttttttttttttttaagtagagatggggtttcaccatgttggccagtctgatcttgaactcctgacttcaagtgatccattcctctcagcctgccaaagggctgggattacaggcatcagtcaccatactcagcccagattttattttttatgactgaggagtattccactgtgtatgtataccatattttctttatccattcctctgttattagatgtcccgtttgtctaacccatatctaggctgtttgaatagcagtaaacatggggatgcagatgtgccttcaacagaatgatttcctttcctctggataaattcctagtagtggaatgctggatcatatggtaattctgtttgtagttatttgaggaaactctgtactgttctgtcttgtggctgtactagtttgtattcccaccaataaagtgtaagtgttcccttttctcctgtccttgtcagcacttgttactttttaaattgaattgtttatctttttccccgtttgcccatttgcccatttttaattggattgtttatctttttcctgttgagatgtttgagttacttgtatattctggatattggccattctttttgataatagccgttttaactggggttagagttgtggttttgatttgcatttccctgatgattagtgctgttgagctttatttatttatttagacagaatcttgctctgttgcccaggctggaatgctgtggcctgatcactgtccactctaagctcaacctcctgggcttaggcaatcctcctacctcaacttcctgagtagctgggactacagatgtgtgccaatgggcccagctaatttttaagagttttttggagagattgggtctcgctatgttgcccaggcttgtctcaaattcctggccttcagcgatctttcagcatcagcctcccaaagtgctgggactacaggtgtgagccaccatgctctgcccttctttgtttttgttttgtgaaagagacaggatctccttgtcacccaggccagaatgcagtagtgcgatcctaactcattataaccttgaactcctggcctcaaggtatcctcccaccttggcctcccgaacgctgggattacaggcatgagcccctggtaatagcacctggcctatttcatttgttttttggccatttttcttcttttgagaaatgtgtctgttcagatcatttgcccattttttaattggatttgttttgctgttgagatgtttgagttacttgtatattctgtatattaatcccctgttggatgagtagtttgcaaatattttctcactttctgtagctcgtctcttcatgatgttaatgggttcttttgctgtgcagtagctttttagtttaatataatcccatttgtttatttttgcttttgatgcctgtgtttttgaggttttacccataaaatattttcccagaccagtgtcctaaaatgtttcccctatgttttcttacagtggtttttatcatttcaaatcttttttttttgagacggagtcttgctctgtcgctcaggctggagtgcagtggcacgatctcggctcactgcaacctccgcctcccaggttcaagcaattctcctgcctcagcctcccgagtagctgggattacaggcgtgcaccaccacgcccggctaatttttgtatttttagtggagacggggtttcaccatgttggtcaggctggtctcgagttcctgacctcatgatcctcctgcctccgcctcccaaagtgctgggattacaggcgtgagcgtgagccaccacgcctggctaaggatttataatagatttaaagcattctgatgggcaaagaaccagggaaaggaaagtcaaaggcagtactgtccaatatgacatgtaattttaaactttctagttgccacattaaaaaagtaaaaataatcgtgtgaaatcagttttgttttttcaattgagacaaggtctcaccacgttgcccaggctggtctcaagctacttgggctcaagcaatcctcccacagtgctgggattacaggtgtgagccaccgtgcctggccaaaatcagttttaatatatttctttaatctaatatatccctaacagtatcaccatgttggtcaagctggtctcgaactcttgacctggtgatccgcccgccttggcctcgcaaagtactgggattacaggcgtgagacaccatgcccggctctcatttcgaatcttacacttaggtctttgatttcttttgagttgatttttgtatagggtgagtgttgggcgtctgcttttattcttctgcatatggatatccatttttcccagcaccatttattgaagagactgtctttttcccaatgagtgtttttggcacttttgtgagaaatccgctggctgtagataggtagattaatttctgggttctctgttttgttccattagtgtatgtatctgtttttaatgctgcaccatgctgttttggttactacagccttgtagtatattttcaggtgttgtattgtgatacctccaactttttgctcagggttgctttggttattcgggggcttttgtggttctgtacaaattttaggatttgtttttccgtgaagaatgtcattggtattttgatagggattgcattggatctgtagattgctttgtgtagtatttctggcactttctcatcttgcctgactgaaactctgtactttagagcaactccctatttccctctcccttcagctcctggcaaccaccagtctaccattttactttctgtctctatgagtttgattatttaagatacctcatgtaagtggaattatgcagtacttgttgttttatgattggcgtatttcacttagcataaagtccccatggttcatccattttgtagcatatgacaggatttctttttttttttttttttttttttgagatggagtctcactctgtcacccaggcaggctggagtgcagtggcgcgatctgggctcactgcaacccccgcctcccaggttcaagtgattcttctgcctcagcctcctaagtagctgggattacaggcatgagccaccacgcctaatttttgtatttttggtagagacggggtttcactacgttggtcagcctggtcttgaactcctgacctcaggtgatcctcccgcctcggcctcccaaagtgctgggattacaggtgtgagccatcatgccaggtccaggatttctttagggctgaataatatccagttgtgtatatgtaccacatttgttgatccatttatctgttgagagacacaagttaattacacgttttggctattgtagtgaatagtgctgcagtggacaagagtatgtaaatatctcttcgagatcctgttttcaatttttttagatatatactgagaagtgggatttctggatcatctggtattccattttaaattttttgaggaacgtccatactgtttttcatagtgattgtactgttttatagtcccaccaacaatgcacaggagttctaattcctccacatccttgccaacacttggttttctgtttttttgttttttgtttttttttgatagaggtaattttaactggtgtgaggtgatacctcagtgtgatttgatgtgagttttgccgatgattagtgatgttgagtagcttttcatattttttttggccatttatgtatcttctttgtaaaaatgtctattcaagtccttagctcattttaaagttgtgttatttgtggtttttgttttgttactgagttgtaggagttttttttttattctggatattaaacccctatccaatacatgatttgcaaatattttctctcattctgtaggttgccttttcactcttccttggtttcattctggttttggttgattgcttgccttgctgcacagaagtttgtaagtttgatgtaattctgtgtctatttttgcctttgttgcctgtgctttttgttttgcagccaagaaatcattgccaaattcagtatcatgaagcttctctatgtttccttctagttttatggtttcaggtcttatgtttaggtctttaatcaatttttagttattttttatttatggtttaagataaggatccatcttcattctgttgcatgtggacatccagtttttccagcactatttgttgaagagattattctttccccattgcgtagtcttggctcatcatttgaccacatacacaggggtttatatctgggctgtctgttctgttccattggtttacatgtctgtatgctagtactattttgatcactgtagctttgtaacaagttttgaaatcagaaagtgtgaagcctacagttttgttcttaatcaaggttgttttggctatttggggtcctttgagattacttactgatttcaggatggctttttctcattttgcaaaaaatgacactgaaatttgatagagattgcattgaatcagtagattactttggatagtatgtacattttaacaatataaggtcttccagtccttgaacatgagatgtctttcccatttgtgtgtttaattttttcctcagttttttgtcatttttagtgtacaagtcttttgcctccttgacgtttatttttaagtattttattttagttttactttatttttttagaaacgggatctcgttctgtcacccaggttggagtgcagtggcgtgatcatggctcactgccacctcccactgctgggctcaagagatcctcctgcctcagccttccgcgtagctgggactacaggcctgcatcaccatgaccagctaacttttaaattttttgtacagatggggtcttgccatcttgcccaagctggtctcgaagtgctggaattacaggtgtgagccactgtgctggccttattcttaagtattattcattttgatgttattataaatggagttattttcttaatttcctttttgtgttgtttattgttaatgtatagaaatgcaacttatttttgtgtgttgactttgtatcctcctgctttgcttagtttattataatagttctaacagtttttttgtgaaacccttagggtttttcatgtataaaatcatgtcttctgtgaatggagataattttacttcttcctttccaatttggatgcctttttttcttgcctcctttttctgattgtactgtgttgagtagaagtggtgagagtggacttcctagtcttgttcctgatcttagagggaaagctttcagtttttcaccattgtaatgtttgctgtggactttttatgtatggtctttattatgttcaggtaatttccttctattccttcctagtttgttgagtgtttttatcatgaaaggtgttgaattttgtcagatgctttttctgcaccagttcagattgttacatgatttttgtccttcattcggttaatgtggtgtattacatttactgatttttgtgtgttgagccatccttgcatcctaggaataaggctccctcagtcatcgtgtatgattttaatatgcctttgaatttggtttggtaacattttttgagaatatgtgcatcaaagtttagaagtgtttcttcagtttttttggtgagactttgaggaggtttggtattaatttttctctaaacgtttggtagaattccccagtgaagctatctggtcctgggctttttttgttgttgggaagtttttaaaattactgagtcagtttccttactagttataggtttgttaagattttctgtttcttcgtgattcagtcctggcaggttgtgtgtttctaataattcatccatttcttctaggttgtctaaattgttggcatgtgatcgttcatagtagtctcttatccttttcatttctgtggcatttgttgtaatgtcccctctttcatttctgattttaattatttgagtcttgtttttttttcttaaatctggctaaggatttgtcaattttattgatcttatttaagatctttttaaatgtaggcatttactgctataaacttccctcttagcacggcttttctgtatcccttaagttttggaatgttctgttttcttcttcatttgtctcaagatgttttctaaactgccttgtgatttcttctttgagtcattagtttttcaaaagtgtgttaaatatttgtgaattttttagttttcctactgcttttgatttcccattgtggtcagaaaagatacttgctatgatttcagtcttcttaaatttgctaagacttgttctgtggcctaacatgtgatctgtcttggagaatgttgcatgtgtacttgagaaaatgtgtattcagctagtgttgggtgtagtgtttttttgtttgtttgtttttgagatggagtttccgctcttgttgcccaggctgcagtgcagtggtgggaactcagcccaccgcaatctgcgcctcctgggttcaagtgattctcctgcctcaccttcccgagtagctgggattataggcatgtgccaccacatctagctaattttgtatttttagtagagacagggtttctccaatttggtcaggctggtcccgaactcctgacctcaggtgatctgcccacttggcctcccaaagctgggattataggcgtgagccactgcgcccggccgggtatagtgttctttatgtgtccgttagttccagttactctccagtgttcaaattctgtgtctcctcattgatccgctctccggtggttctgtccattattgaaagtggggatactgaaatctcctgctgttactgggttactgtctgttttttctttcaattctgtcagtgtttgccttgttatatttgggtgctctggttctgcacttgcacctttacagctgcgcttggctggagaattaacttggctgattggccttaccactaattaccactaagttcaggagagtccttaaaactgcacagcagtagttcctagttcatttattctcccagtgtgacctaaatgatcatttagacctgctccttctcaatccttcaacgtcactttcaccgtctttagcacacaactttgcttttcattttgttgagaaaacagataccacaagaaaaatatctgcaaagctcctgccactactgcctgtgtctgtgcttcatgtattctcacatccctcaattattacggaatgaactgaccatgcttctagccagggccaaaacctgcactgtgctcactcagcccttgcctctacactctgcagggtcattctcctccacaacaacatactgttgtttctctcatcttaaaacacaacaaaacttctctgaactccatttttccttctaaccgttgttcatttcccaccccgaccccttttttccctaaaagaagtatctgcactttgtttccaatttttctcctcctgatatttcaggaggctttccctcccagcaccctgtttcttgcactgctcttgcgaggtcagctctgaccctacctttctcatccttgaattatttgacctagtaacagtatttgacactggtgattacttatttcctgctcgttgaaacactttgttcacttggcttccaggatagcatacaaagaaattccccatctcagtcttttgtcacagagtccctccagggctcagtccttagacctctgttttaactatgctcatttccttgttgatcttatttgacccactggctttgaaaccctctttgttttaaagtttgacggaagtccaaattttaaatctccagcctgagccgcttctttgaaatgcagacttatgttccacctggatgtctaataggcaaatgaaatgcagctttctctaaagggaacttattcttcctccagtaacttaatgggccatgcttagaatggctctttttgtccaagaaaattcaaaaccaaaaccaaatctattttcttctgctttaacatcagtctacagattatttttggtctaaagcatgagatagggctttttatttatttttaatcaggcggctagctagtttcttaacagtattgaataatatatttttaattgtttgaattgtcatctttattgttctgagaataatatcaaggatttaagtgaaattgccatctaatgtttgcattatagatttcatgcccctttaaaacatgtgttatatcaattgagagcacactcttataaagtacaatcaatgataatcaatggattttttaaaaaagaactaaataagttgcataagagcacagaaacaaactttaaatttagcatttaatagaccaggaacaacacaccagtaaagaaaggggtcactaattactgtttggatacttggattttagtttgaaaaataagtaaaatttacatagtaaaaagcaataaagtaaatttaacacggaaagtaacaatggagtatgaaatatatgaccaaactaatggaagtttctgtctaaaataaaagatctatttgtagggtaagtaattagattgggagtaaaaggcagaaatagtaaaatcatcacatgcacaaatgctgtctgtatttaatcccagttaaagacatgggaaataagataaccctaaggctataatgctcacctattaaactgacagaagtatgtaatatgaggaaatagcatgtcttgtttggtcagtgtattagtcgattctcacattgatacaaagaaataccaaagactgggtagtttataaagaaaagagaattaatggactcacagtaatgcaggctatacaggaggcatggctggagaggcctcaggaaacttacaatcatggcagaaggggaagaggaagcaggcctatcttcacatgacagcaggagagacagcaaagaggggaatgccacatgcttccagatctcttgagaactcactatcatgagtacagcaagggggaaatctgcccccccccataatccaatcatctcccagcaggccccacctctaacactcaggatcacagttcaacatgagatttgggtgggaacacagagccaagccatgtcagtcagtatcataaattggttcaaccatagaggaagagaatttgactaaatacatattttagggaaaagggaagtactgtgggctcagcggtttgatcttaaaatttctatgcagtgatggcatactatattcctaatctaactagggtttgtttcaagggaattagggataaggtgagtaagctagtaaacccaaggcaaaatttcttaatgctttttaaaatttaaaaaagaggcccattccgttagagcatacattgaatcaaatgtttcatgtaaaacaggatggaaatgaacttttctatttggctaagtggtgtaggcagaaaaacctataggctttctcttttcatcaacttcatgctgagtcctgtctcattttattatttacacaattgaaatataaaaaattgttcccaaatgatgccccccataccctaagtttagggggcagtagtgtaaagcagtgtccagacattggtcttagggctggagtggaaacagactcctagaggtgcacaagcacatggataattttacctgaatcaatttccaaatcctaaactttaaatgtctcttttttgaagcatttcttcctttgaaccagtgttcaagcggttcttccctttttattttttgatgtggagtttggctcttgtcacccaggttggagttgcaatagtgtgatctcggctcactgtaacctccgcctcctgggttcacgcgactctcctgcttcagcctcctgagtagctgggattacaggtgcctgcaccatgcccggcttatttttgtatttttagtagagatagggtttcatcatattggccaggctggtctcgaactcctgaccttaggcgattcacccacctcagtctcccaaagtgctgggattacagttgtgagccactgcgcccagttctgttttcaaattcctttccaccatggctttttccattattaaaaaaaatggcataactcttcctctgacccttctcttaccatgatgcacttgccttgtagtgggaaaacctcagggatgaaaagggtgtcaggacaattctaagacaccaatggaatagtgctggaagaattagatattcagttgcaaaagaatgcaattagacctttacctcataccataaacaaaaatcaactcaaaatgaatcaaaaacctaaatgtaagagctaaaaccataaaaatcttagaagaaaacataggtataaatcttggtgaccttggattaggcagtgatttcttcaatatgacaacaaagcacaagcaatcagaaaaaagtagataaattaaactttatcaaaattaaaaacctgtgtgcataaaaggacgctgtcgagtgagaaaacaagccatagaatgggagaaaatactgtaaaatatatttgataagcagcttgtgtctagaatacataaagaacacataactggctgggcgccgtggctcacacctgtaattccagcactttgggagactgaggtgggcggatcacttgaggtcaggagttcgagaccagcctggccaacatggtgaaacgccatctctgctagaaatacaaaaattagctgggtgtgatggtgggcacctataatcccagctgcttgggaggctgaggtaggagaattgcttgaacctggaaggcagaggttgcagtgagccaaaatcatgccactgcactccatcctgggtgacagagtgaaaactctgtcttagaaaaaaaaaacaaacaaacacgtaactaacttagaaaaccaaaaatctaatttaaaaacaggcaaaggattcagatagacattactccaaagaagatgtacaaatggctacataagctcatgaaaataatgtcgttagtcattagaaatataaatcaaaggctgggcacggtggctcacgcctgtaatcctagcactttgggaggccgaggagggcagatcatgaggtcaggagatcgagaccatcctggctaacacagcgaaaccccgtctccactaaaaatacaaaaaattagccgggcgtggtggcaggttcctgtagtcccagctactcaagaggctgaagcaggagaatggcgtgaacccaggaggcagagcttgcagtgagccgagatcttgccactgccactgcactccagcctggacgacagagcgagactctgtctccaaaaaaaaaaaaaaaaaaaaaaaaaaatatatatatatatatatatatatatatatatatatatatatatatatcaaaaccacaatgagattctgcttcttacccactaggatgtctataatcaaaaagatagataataacaaatgctggtaaggatatggagaaatgggaacctccagacactatttgtgggaatataaaatcgtgcagctggtctggaaacagattagcagttcctcaaaaagctaaatgttgagtttccatatgatccagcagttccactcctagatatatatccaaaagcattaaaaacatgttcacacaaaaatttgtgcatgaaagtttacagcagcattattcataataggaggaaacaacccaaatgtccaaccgataaatagataaacaaaatgtggtctgtctaggcaatggaatattactcacccatgaaaagaaatgaagtactcactcattttacaacatagatgaattttgaaaacattaatgcaggttgaaagaagtcagtcacaaaatatcgtatgttgtattattcttatttttatgaaaggtccggaaaaggtaagtccacagagaaagtagattagtgataaaaatgtactggaattagtgttgatggttgcacaactttgtgaatatgccgatagctactgaactg

SEQ ID NO: 6 - DNA, 174289 bp, Homo sapiens
gccatgccaagactccttagagacagctgagaaagcccagttcctaaaatatcattggctctccatgtccaggtttcatcctgtggcagacgccactgaaatcttctaaaaggataggatgcgagttccctcctttggggcaacagtcgtggtctgaacagagacgtggggagggaggcaggaaatgggatggcagctggaaccccagctaaggggtgggtagaggcttctccgctggtcgcagggactcagctgaggccttttctgcacggctctaacccaagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgcttccctgcccccccttcctatctgcttgccctgcctggggcttcactgtgcctctggccattaccttctaggacttgcccagcccacaccaggtcgcgcaccggcgatttctcctgtagaacaaagaaggaaatagagggaccgagaggggtgggactcgaacccaagtctcccactcatctcaccccaccccaccccactccaccccaccccacccctccactccactccactccacacatcccatccagccagccttttctgcctgctggtgcctcggccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcctgagactgggccgtggatccccggatttggccattcagagaagttcaccttggagggggtgtgcgagaggggggtttcctctgcggccgaagaagggttaggagcctgccttctgaagacctagagtccgagggaccttcgaggccatttagttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtgtgagtccctacggccgggcggggagcggggatgggggactcggtgccggggatggggcgacccacgcccccacgccccactccccagacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgggggcggcctgcgggaatgagcaaagaggaggaggggtgctgggactgcctgccttgctcctgcgacccagtcccgacggtgcctcccgcctgcaggtgcccgcgctgcgcggcgacgacggccgctggcgcccggaggacctgggtcgactactgggcgaggtgcaggctttgcggggagtgcaggagagcaccgaggcgcggctgcgggagctcaggcagtgcgggggcgggcggggaaagaggggacaggggtggggggttcgggatgagaccataactggccggccagcagttctgggcagccccttcctctctcctgccttggcgcctccatctagacttatgggcgatctctgggatggccagtcagcggggtggtctcctgggtccccagcctcgccattctgtggggggtggtgactgggcgaactctcagatgcctcagcaccctcccaccccttcctcaggcagaacgagatcttgtggcgggaggtggtgacacttcggcagagccacggtcagcagcaccgggtcattggcaaggtgttcctctccccaagcctcgcttctccctcccactcctcgacaccccattccaccgcccagtcccccggcgcccctgttaagccttcctccctcacctggaagtgcgggggtgggggggctgtgtccaaagtatgaattaaacctttgctttctcttcagctgatccagtgtctctttgggccacttcaggcggggccgagcaatgcaggaggcaagagaaagctgtgagtgagaaagccaagaaggcccacacccacttccaagaccccccagaagtccccttgcaaggaccccttctcctctggaaactccttcaccgggaatcctcattcctccccctgcgctacaggcttcctcaccccatctaggatccacttccccccaactctgccacctggtatccccactcccagatcctcccattccaggaccttattcccaaattcctaccccagcagccccttccccctccggcaaggcttcccaacagctgagaccctggggctcaaaccaggttccctccctcccctctctacccacaaagggcccccatctctagggggagccccttccacctccagcatgtgactgacaccctagcaacaggcctcagctctgctgacttggctgctggggcctgagggagggagggaagtgcaggccgaggtgcatgggggctgaccctgccccacccctgcctgtgccctgatcgaccacacaggtccctgatgctggatgaggggagctcatgcccaacacctgccaagttcaacacctgccctctacctggtgcccttctgcaggacccctacttcatccagtcggtaggtttgtcttcttcccccttcccaagggcatggctgggcttatggagagcctgttccttctccccatcccctaaaaggaagagaagatggaagccagccttccccccaaccagacccaggccctccagcatggactgagcctcctccctcaaaccttctcccttagacctggcccaggtgggtgttggtggggttctggctctccctgtgcctacaggccaagggctgggcctagccttctacttacagcctctcccagagacaaatttgggccttagccctcacagggccaggggccccatcatctctgacatcccagaagactctccatcccctgaggggaccaggctttctccctccagtgatggcaggaggtaagggggacagggctgcccctgaggggcctgtgggggagggcctggcagcccagatggctgtaggggtagagggagaagtcagtgccagggtctggttgaagcttttctctggtgcagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacaggtgagcagagccccagctggcccatgagccctgtgatagaacagcccttaccagcccacaaagcttcctagccatttgactccatgatactcacctgatttcttggccccagcatcagagttctgtggaaagcagagcctcccagtcagggcactcagcatctgcggaagggcttaggaacctacatatgaaatgagttccctggggtgactgcaaagtacacaatagtttaagaagcattggtggctatgaggtggctcatgcatgtaatcccagcactttgggaggctgaggcgggcagatcacttgaggtcaggagttcaacaccagcctggccaacatggtgaaaccccccgcctctgctaaaaatacaaaaattagctgggtgtggtggcgtttgcctgtagtcccagctactcaggaggctgaggcaggacagtcgcttgaacttgggaggtggaggctgcagttagccaagacagtgccatagtgacatagtgggtgacatagtgaaactgtctccaaaaaaaagaaaagaaagaaagaaggaaagagagagagagagagaaagaaaaaagaaaggaagaaagaaagaaataaagaaagaagagaaagaagcatggatattgatacttgcatagggaggggaagggtcccaaagccccagctccaccacccaaacttcaggtcccaggtaggaagcagaggcactttctctgtgccatttatggcaggagtggggaggttgggggtggagagaggatggggatcctctcctatcattttctaaagattgggggattaaaatcttgatgcatctgggttccttgggaacttaatgcggggtggacactgcaggccaaaagcagttctgtctgcacagggggcctctgggcctggaaagcggggacaggagcccagagagtctgctgcctccgatgctgcttcagccccctcaagaaagtgtggaacctgcagggcctctagatgtgagtaccccttctgctgaaacaggggcatgagacctggtggggtctagctctctgtggagcctggggagggcaccactgacccagagctctcctcaggtgctgggccccagtctccaagggcgagaatggaccctgatggacttggacatggagctgtccttggtaagaagtgggtcggggagggcagaggccaggggtggctgagtcaagccctctggtccatagctgttctctgtgagccaaagccgtgtctctagaagaattgtcacagtgatttcccagctgtccccctcagctgctaggtcccctccccagctgctccctgcggttctcacgcagatgcagcccttggttccagagcggggtgagcctgagctggcggtcaaggggttaaattctccaagcccaggtaatggttgtgatgactcctacctgggaggacgccgtgattgggctgagctaccttgattgagtgagggggcaatctgcaatttgcagggaaatcctgagttcaggctgcactgcagagcgttccttgagccacccatgccctcaccattgggcgagagtggggaggttaagaatggatgttttatcctaactgagcagaaggcaggcgggcagggctctccttccctgaagaaaggagggggaacatttcccctggtgagcgcagtcccacttctcctagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttctgtttctggtctcttttctctatcgaccagggagcacaggagttatgggtggggggtgattttgcatttgtagaagcgtccagatactaggtttttaatagaggaaccccaggagggtggaggtgcttggggatccggtgcctagctcccttgcttaggcccgggtccagggctggcgcggggccgctgcaatctctgggaagcgggggcttctgggtcgcgctcagctctgcaatgcatgcgttctgtgatcctggtgagttggtatccttctctgaacttcctctgtgacaggcagagaagaggggtcgatgacaagatagatggaaagcacctggaaattggcaggccctgagtgggcgctggacgtgtggggccgcgggccgaactgccccctcctggcctcatctcctggtgcgccccgggtggggagggaaagctgactacatgcacgtccccagccagcgcgcggcctccgcggtgtggctcctagtgcccggggaagaaccctcaccctccctattcccagcagccctggccgccccgcccccgccgcagctgctgcacccacccccaccctgcccggccctttctgcaccgtcatctcctgccccgccgaggcttgacccgtgagtggggacgcccaaaacgggccagaccgggagccccactcccggctgtgggagggaagggaaaccgagattgggcagaatcagcgccccaccacccgctgcggcgctcgggggtcgggggggcggggtgggtaggactgtgggccccgccctgccgcaggactctcaagctctgggactgggtggagggaggtaaggggcggggggggaaaatccgtgcagtcgcacatgcgcaaaggctcttcactgtcccaagaccctggcttcctggccaaagagcccgcgcagcgaggtggggttgggggctgggacccagctccgtgccccgccacctggctctctgggaagaatcggacctgtcaccctcgaaggactggccgctaaataacttcggtattgagagctgtgtgagcctcaaagggagggcccagaccagctggagtctctacccccagacaggataaagggcaggacttggggtcataggaggaggcggctaacatgaaaacaacttaggttggagagaaggaggggccaatccaatctgcaccctccctgtgtctgtcccgagtaggtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcatagtgagttctccgatccctggctggtggagggaagctgggaagggcctggctgtccagggtggtgggaggaggctagagtagccagaccagatattttgggttgtctctgatgggcagtggggtgtgggggggaggtagataggtatttaggatggaattctgctagacaggaaaatatagttcagttcctcatagttcaggctggagcaagtaagattccagttttaccactgaatctctgagcctgtctcctcatctgtaaaatgggaacagcaatcctagcccagagggttgtcaaagtcactgtgctatcgggcctggcagaatgggagtgagaggggctcagagggactgttacaggacatgaggtgacgatggtggggtggcaaggcaggagctgatggagactcactgagaagtggagaagcaagattcatcacatacgggacataaagggagatggaggggcagggggtagtcctggtctcggcctggtggggaagggcttcaatgggaggaagccagggtgtgaagtgacgggggaggtatagtgtgacaccagagggtactgagaaagacctgggaggcaggatggcggctaggactaaatcctctctcccagagaaggccgagcctcctagagccagagaaggaggcagaggagggacagcaaagggaagaagagatgggaggatgccgtgtgaacaaagccaaggcggggaggagaagaagttattatcagggtgggggtgggctgagggcatggttcaaggcctgatgtctttgcctcctaatgccgggggtcttgctggctgggtcaggccactcacaggaatgggccataatccttggttgacaataaatggacaaagcagctgggtgcggtggctcatgcctgtaatcccaacactttgggaggccaaggtgggtggatcacgaggtcaggagttcgagaccagcctagccaacatagtgaaaccccgtctcaactaaaaacacaaaaaattagctgagcgtggtgcgggcacctgtaatctcagctactcgggaggctgaggcagaagaatcgcttgaactcaggaggcagaggttgcagtgatgagagaatgtgccactgcactccagcctgggcaacagagtgagactctgtcaaaaaaaaaaaaaaaaaatggataaagcagattgactctccctaatagccgctgttggtagagatagtctctcaagagccaggcatggtggttcacatggtggttcacaaagtgctggtaatcccagcactttggaaggctgagatgggaggattgcttgaggccagcagttcgagaccagcctgatcaatatagcaagaccaggacaggcgcggtggctcacgcctgtaatcccagcactttgggaggccaaggcaggtggatcacgaggtcaggagttcaagaccagcctggccaacatagtgaaaccccgtctccactaaaataaataaatacaaaaaatatatatagcaagaccccacctctaaaaaaaaaaaaaaaaaaaaaggctgggcacgagaatcacttgagcctgggaggcggaggttgcagtgagccaagattgcgccactgcactccagcttgggcaacagcgagactccatctcaaaaaaaaaaaaaaaaaagtctctcaaaatagtgcgatccatggaggaaaatcagtccaagttcggcaagtatttgtcggtatcctgtatgagctaggccttgggtacttcaagatcaaacaacaaatgtctgtaggtaattcccaggtcagcagggagccaggtgggtcagcagagagacagtcacattaggagttagggcttcagtagggagacaggtgggtctcaggtgatgtcaagagatcttggtcagagctaggcctgaagaagattctggtatctctgctcaggaatcaggggaccaggaagggccaggagactacattggggttgcactatggtggtggtgttggtgggagggtgtagaggcggggcttgtcctggaaagttggatatcagggtcaaggtaaggggagaggggcagggaggctctcagcactttgtgctctgggttcagaggggactggaggatagagtatggaagcagggagctctgatcctgggttctgcagggccaaagcaggaggcagaaggctggacttagtaagtggtgaggatggtgagagaaatattcagcagtcagactggaaaggacttgtctgcaagctgggtgtggagtatcagcatcaatcctaggtttttctgcctggttaggtggggaagcagatttgagagaaagaccttagtttggataaacggggtctgaactcgcctcggatttgccgggggtggagctcaggacgtcctggttggggagggcattcagagagtagatgccagtcctgggaaaggcaggggaggagaggagagccacggctgacgcttggggacagaaggaggagcctgaggaggagacaggacagagcgtctggagaggcaggaggacaccgagttccccgtgttggcctccaggtcctgtgcttgcggagccgtccggcggctgggatcgaggtgaacttaaaccccagcctgggtgttcactgggggcattgagggagtggtcagaggcggcgagggcagcggggagggcaaccccccattacttctctcccctttccccatgcagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggtgagcgcgcggggcggggcctagggcagagcagggacggggctggggcagacaaaaggcccggggagggcagggttgtcgtctccgctagaagtaggcgagtgtgaaaccgcacaggggtaaattgagcctcagtcactcccacttccgccccaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaaggtgtgagtccgcccaaaccctgagccggcttggcgggagggcatggcctgggaagcggatgccggaccccacctctttgaccactgttcccgtcatctctagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactgcgtttctgagttttacagatgggaaaactaaggccaaaggataggagtggggttcacacagctaagtctgaagggaaactggaagcagcaaccacctctgcacctcacctggtctaagaggggttcaggacttgggccaccaaactctagggcctgtccctcaggtgcaattgcagctgctcctaggctatgccaacctctgccagagagcagctgtgagggtgtgagcaaagacaggaacagcagaggccagtggagggagtggggaacagggccaagggagctcttgggcttgactctcaaggcctgaatcagtgtgtgtgtgtgtgtgtgtgtgtgtgtgtgtgtgtgtgtgtgtgtgtgtgtgtgtgtgtgtgtgtaatgggagtggggctgggaaaattggtgccttccaagaaggagtgtcctgtccaaccccccgcacccccacggaaccttcaggagctgctgctcccagccacaggaagtagaccatataaatatggaataaatacatgaccagtgagagaggcaaaatgtcggaaagcagaccccaggccagctgggtctctactaccaggaccccaggctcaggccatcaatcaccccaggagaagggagcccgacccccaccaggacccagtgagaggtagacagcacaaatgctgaaggagcaccaaggggccaggtaagggaagggagagactggagtactgggacaaccaaagccatctcatgcaagaacaagtttctattcccaaaccacccccatccccatcaatgctcagctctcttcctgcccccatgccttccctctgctcaacagagagctggaggcaggagggcgactcagtttgccagacatgctgctgcaggtccccagaccccagggaggctggcaagggacacaaacactttgatgttgccactcctcctcaaggaatgctcctgccctcccaacacccccaagaaacacctaggccgtggacgcacagagcaaactgcttcatgttctaggggcctatctggagcttctgtccagggcctctgactgcagccctcaacggacatcagtcgggtagcaggcgacccagctccgcctcatccagccggttggtggccatgatgtgctccagctgctgccggtagcgtgccaagtcctgcatgaagtggggcacccgggtattatccagcaccccatggggccgcaggtggtccacatcctcataggacacctgcaggaggaagccgggcatcaggcataggcagtggcccctggctttcaggtagctggtcccagcccactgcttacagctcacagcctttgctccgggacttcttcctctcccctcctgatccacaattagctacaacgttttatacctctagactcaatccttcatctttgccctttctctcaacagtttctttttgtcatagatgccctacaaccccacttctctctccagcccagcctctcagaccctcacctccaaacatgggcatccaactgcctccttaatgtcttcccctggataaccctcaggatggccccatgtccaaaagtcaactcctgagtgccagcttatgccagctccaccctctttacagtcacccaggtcagattcccgggagggggcttggactctcaccctcccatcagggtagccgctgagttaaaagtattcccctctctgaagagctctccagcttgtcccttcatctccaacccagcggccactgcctggttaggccagaccaccatcccttctgcaggagtgacaggcaaggcctcctccgtgcccctgcactcccttccctagtcctctctccaatccacctcccatatgatgtccagaaggagccttctgaagcaaatatcagagtcactcctctgcttaaagctcctctcactccccgttgcttcagatgaaatctactttcctcggcctggcacaaatgccagtgccagggagttggtccctggccatttctgcagccttcttcccctggccttcctgatcactcccttggcctggaatgctcatctcctttgagatgcagtatctacatacacctgcagcctccgttaagcacctggttttgctgccagagtcatttcatctcctgttctcacttccacccacgctcccccctaccaccacaggcctgacacccagccctcggtctagcaccaatccgaggctcagggaattctacagcaaggcagggagctggctgggacctctgaaggtccacagcccctcaccttgcccagtgaggtcagcaacgggaaatcgatggtctggcgatgtcgcagaatgcgcacgatgccgtccaggtacacctggtccttgctgaaacaacctgggagggcaggagggcggtgagccccgcccctcgcccgaagccccgcccccaccccggctctaggcacctcccccgcgctggcgcacacctggcagcgaggtgtcggtctggccgcgcttggcgcgcacgcagtactcccagcgcacatcggcgtcctgcacgtagcgctccaggtcctggaagagctgacggaaggacatgcgcgcggcgcggtggatggtgtagtagagcagtgcagcgcgccacaggaacggctgcttgcggaacagcacgctgtgcaggctggccaggccctcctccgtggggttcgccggccgcagcccgtaccgcagccggccctccgcgttgtgccacggctggcgcgcgttgttcacgccccgcaggtagtgggtgcctgcggggaaggcgaggggaggcggcgctgggcggggcgttcggggacccgcctgcgagcccagccctggccctgttccatctggccggggctctggccgcgacacttccatcctcatgctcctgaactcaggctcgcacacaggctctcccagccccaggcagcgtgaagctcctcctcctgtggactcgcacccaaggatccacagaggctcacatacatgaatcctctcccacccatccgccccccaccctacacccacgcacccacacacgtgcacgaactctcccaaactgacattgcccccagccctcctgggcacaagaatacatataccaccctgcccaacatcctgggtgcccatatcatcttgaacagtcatgctgatgcccccggtaaaaatcactcttgcccagagcaacaggattctcgaggaagagggacagacagataggaatagtggttagtgccctgcacccccctgcccaaactggccagtcccctcctaaaccaggtgccatgtgtcctcaagtcaagtccattcccaggacctggccttccatccaccctggagggccagcgtggtggctggcctggtgggaccctgagggttctttctctggccggtcagggcctgaccagccttgcccgcactgttgggagaagtcggagaggaagtggagagagaaaaatatacccgaaaggaccaagagatgagagcgagcccagagcatgggcaggcatgttctggcctacctctgtaagcagagggcgggaggtggctgctcaggaagggaaagccccgacctcaggagggaagggggagaaacaaaaaggggagttattggggcccctccttcccacccctcccagctcccaggcccctttcatgcctacccatctgcccggatacccacaccctgacctatctcatgccgcagcatgccctccaaccagtactggcgggctccggtcaggttgatcgccaatgtgggccggctgttctccaccatcatcactgcctgggacagcaggtcctcactcagctgcaccacaacctgcaggtggcagtgctctgagccatggccaccagcctggggccagggtgcaggtggacccaatgatgccacagggcagcgaggccagacaattggccagggcacccacccttcatcacctctgctcagaaccagctcccacctcactggggcaggggcaggggtgggtcaggtgtggagctggacctgggaccgcccacaagacaccctgatttggggcatgtagaggaagggctctgcaggcaagctcacctccccagcgcagccctccttctgcatgtatttgcgcacaatcgaccatatctggcacttggtgagcagctgccccccagtggcagcctcaaagtgttcataggttccaaacttctccagaacagcctcaatgatgccaactgcctgtacacggggccacagtggctggtcaggacaagccccttgggtggtcagggccaggatacggtggggaggctggactgacctgatggatgaactgtccagaggcctcgcagtacttttccagcacagccgtgggcatgggctcctggtactcaaactgtggattgtaggtgtaatgggactggaagaacttgtctcgctcacggtccatgttggttggccgcagggccaccaacatgcaggggctcttgctggcaatatggcctgcatccctttgagtcttagcaatgtgaggcagggaggctgcaggccgcagggtgcccccacctgggttccgtccccgtccaggtggaggccgtcccagggtgccacgcccccgccggccagtactatttacagagtaggtgctctcactgcgacgcatgtggccacggtggcccaggagcatctgtgagaacggctgctgctcaggctggggctgcagcgctggggggactgccagagccaggggcaaggccagggactgagaccaggggtacagtggtggcccatctcggtctgagggcttcagcctatggcgcagggatgggggactggtaggcgggctggggggtgcctgatcatacgcctgagcccctgagtccagcaccattctgtcctgggggtcacatccagccgggtcactccaactccccacactgtcgacctctggggacacagaagggcatgtggagaccagcatgagtgggtgtgaccaaacgaccagcaggccctgtactccacattgcctctgctgggcccttggtgggcccaggctctgctaccaggggtctgattggctgcagcgtccattgcctccagcagactcacccaaatatgctgggccggaagaaagcacttttgttttcgtttttgttttttgagacagggtctcactctgttgcccaaggtggagtgcagtgcaatgatcatagctcattgcagcctccaactcctggcctgaagtgatcctcccgcctcagcctcccaaagtgctggaattaaatgcatgagccatcgcacccagccgaaagcaagagttttaaacacccacctaggtggtggttactggaatcctctcagcctgagctcctgaaggcaaggactgagccccttactcgtgattctaatctctgtgctcactcacttaatctgggaggtggtacagtgcagcttcagctgcctgggcagattaggtaggtgagaagacctcagggactgccttcagcctatggcatcttctcagtgccacccctgcccatccacctggctttacccatatcctcctgcctatttggcctcagtcagtttcaatgtttgagggccccatgcttacgccggtaccccccagaatgccctctctcctctgagccatctgttgaaatccaaattagaatctgcttttgggaagcagaaggaagcttcagcaaatccaagccaatctctggcttgtcccctatctgagggatctttccagtggtcatccaaagccagtgtcagggcgctcaccccgactctgttccaggactcagtccaatcccaaccctccccagagactacctggagaggctccagctgctgagctcccttgcctgctcagtgactcacttccagcatttctcctctctcctacatcatcaatctcttcctctctactggactctttccatcaggataaacacatgctgttacttctccatcttaaaaaacaaaacaaaaccctcactagaacccacactcctccagctacagccccgctgcatctccctccacttgctcctattgcagcacatacctcgagtcatctatacccagtctccagttccttttttcctgttctctcttaaattcactccaattagccttttgttcccagcactccatccaaattgatctgatcaaggtcaccaatgaccagcaatgaccttcatattgatcagcacccgatacagttaatcactacctcctggaggccaggcagggtggctcacgcctgtaatcccagcactttgggaggccgaggcgggcggatcacctgaggtcgggagttcgagaccagcctgaccaacatggagaaaccccgtctctactaaaatacaaaattagctgggcgtggtggcacatgcctgtaaccccagctactcgggaggctgaggtaggagaatcgcttgaacccgggaggcggagtttgcggtgagccaagattgtgccatggcactccagcctgggcaacaacagcgaaactccatctcaaaaaaaaaaaaaaaaaaaaaagtcactgcctcctggaaacatgctgtccacttggttttccaaacacagtcgaacttagttctcctcctaccttgctggtcatccctgtctccctgacctcttaatactgtaatgctccaggacttgcctatggaaacttctccatttacgttcactccctagatgttctcatccactcttgtggttttacatacattagctcagacttcttccataaactttagaccagtgttgccaatttcagtgcaatttgagatactgtctatttgcccaggctggtcttgaattcctggcctcaagcaatcttcccacctcagccttccaactagctggaaccacaggcacatgccatcatgtccatcttcactgcagtgtcatcacttgaatgtttaataggcatatcaaacagaatatgtcctctgtctgggatgttcctccccctgtataatggcatgggtcactctctcactttcctcaaatctctgcatcaataccatgttattagaaaagcctaacacaccctcaataaaatagtaaacctcctctcccctctccactatctccccttccccaaattattgttctttgtagcagtcatcaccatctggagtgtacttcagtacagtttatatttgtatgataggtatatttgatagttatctgttttatcttttccaacattcacagctgtgtccccagaacccagaacagtgcctggcccgcagcaattgctcaataaataaatgaatccaagagctcttctttcagaactagaattattccttccctgcactttgcttccctatctagacttcatcttccccctctccactcctctctaccctgcctaatgaccagctgcttgaaaagacttcaggtcccaggcttcactccctttaactaactgtacagttttttggactcctcacccctttacaggtttctgcttggcccagtcccctccatctccccttctttcattcgacatacctcctcgaaattaccagaatacgcctgtttttttcacgtctcgggtccttccgccaagaatgcctttgcaatatattcctggagcaaactcttaaccattcttcaaggctcagtttaggcctcacttcctccaggaagccttccccgcgtctagtgtcccactgcttcggcgacttctttactcagagctgtcactgttggagtctaggtccgtgtcctcccacaatcccctgaactccccgaaggcaggaatggggtctgattcacccccgtgtaccaagcacccagcactgggtgcataatgaatgaaggatggatgggggaggagccccccactattaaggcggggtctagtgacaaatgagagggtgtggcctgtgcggagagaagccccggagaggacaaggtgaagagccaatggggaaccagaaatagaggaggggcgtgacctgcagccaataagtggtgggggataaggtgaagggcgtgcccaatggagggtggggccaggagacaatggagtggaggcttctccgggagatcaggaaaggtcgcgtcgcgcgcctcctcccggcctttgggggggtccgtccgcgtgccgtgcccccacctgttagctcctctgctcgccgcccgccgctcccgctctgctacaccggccaccggacgcccagccggcgggagccgtcgccgatgacgtacgtcctcgggcgcgcgcacgctcttacgaaagcgtggggcttcgcgtcagtctccgcggcggcgcgcccccgaggccactgggagcgaagccaggcagggttgagggggcggtgttcgtggtcctgggcccgcccccttcccaaggccacagcgagttgctgggcttcaggggctccaggcggccagggcggcggagactcttgctcacggcctgggcgcggagacgtgggggcgtagcccgcggcctcgggaacgcagtctgcacagagggcagatgcctgcataggcggggcgcagcccgtgtaccaggacgggagccaggatactttaagcgtgtcactctgcaagaattccctcaaccctcgtgggcacttttattccatcccaccttccccaacacacacagactcaggcgtccggcagccgtggtttattctgcgagcagcagggctcgggcgcaggaccccgagggcaggcaggaggccggcgcgagcgcgggcgcgggcactaggctgaagaggacgcggcggctcgcgcggggcgacggcggcagcgcagcctgcagggagctgagcgcggccaggtgctgctcccgggacaagtccccgcgcaggcccaagagggcggagacgtggtcctcgctgcaggggcaccaaggaggcgcgtcagccccgtcctccccgccctccggcttctcttcccttctggcccccagtccgcacctcacgtcgggaaattgttgccgcaggccagccacctccaggcccagcagcgcggggtcgcggaggtttagcagctccctcagggcgagcagcaccggcgcgcagtgcgcgttctcctccaggccctgagcacgtcggggtagggtctcgcgccagccctctctcccacccagccactgagactctcgcccgtctgcccgcccaagaagctctcaccaaactgaggaaaagctgctgaagctgggcagcatcgtgccgcaggcgctcggccgcctgggtcctctcgtcggctccgcggcacaccaggcggccttgcatcagcgcgctcaggtactggagcaccacggcacgctcggcctcagccagcagcagctgcggggaggcaatcaggcgggtgcaggtcgcctctcacccgcgccgccccttccccaatcttttcccccaacccacctgaaccgtggggttccgcacgcgccagaagtcccggcagaagcgccccgtccgttcacacacactttgcaggagctcagggctcgacagccattggcgcgagggcagatccgcgaacaggggctggggaaatgatccagatctggcattgccgcggagacccccatacgtagctgtaccgccacctctccacctgctcccatcctgacctgaaggaggcctcacctggagctccgcctgcagcgcctccaacaccaagcggtagatcctcctctgcaactcgtccagcgcagcttccactggagccaaggcccctgaaggcgccccgtccagctgcaggacagacactgaggagctggaccaagcaaaactacggcttcaggaccaaggccaaggcccgcatggccctcggtggtccagaccctccggcgccaccttgtggggcaagtgtttgacgggagggagcgagaacagcggctctctgcacttctggtcccaggcatggaccagggctgggagacgggcgcttggcgagctgcaaaggacacagcccagcgagacctgcctcaaattcgcggtgcgtccttgaggaaaacattctttcggtttctgtttcctcattcgtaaaggaagggaagtatcccagtgaggagggagtaaaaaatcatcacttgttttccttgcccccaccaaaaagaacataccacccaagaggaagggagtgtgtgtgtgtgtgcgtgtatacacacagctgtaaccccagacattactggcacagagtagggccttgaaatatttgctggacgaatgaacaattgacaccatgtgccaggcactatggtggccactttacatgttatctcatgtgattctcagaacattccattagtacccccataatactaatgagaaaagtgagattcacagagattaggtaactcatccaaggtcacacaactagtaattagcagaactagaattggaaccccagggcgatgtgagtccaaagtccctagtgtcctagtgtgggctgagcccatacataataggtactcaatagggggttagtgaaggtggggttccctgggggccttctggtacctgagtgctgacttgtggttgagggcggccagtaggtagggcacgtaatgaggggccattgatttccccctgaagtggtctcgggagaatcggatcagagcatcactgaagctgcaatgggcagaggtggctcctggacttgctgctatgctggcatccccacagccccagtccctggtactcctgtcccacctccaagatacccaagtccttgtttgaaagagccctttccctgtgacatgtcttattcactcagagcccctttgggctgcctggggagcagggatagggatcaggaatgggtcagtgcctcagcaaacctcctcaagaatgtgcccagttctgacagtgccatgccatgcactcgctgttgcagtgactcactgaccaggctggccacacgaatgttctcttccaggatctgcaggcagaaatgagcagccatcggcaaagcctccctccttcctctcctccccactgccccatggaggctgcctgcctgtctggccacttcccacctacctgcagcacaatggctggcattggtgagtaataggagccagacgggtctgtgttgggcccatgctcccggccccactcagctacctccccatccagtgcattctgcagccactgagacacacttgcctggggggaggggccaggggcaaaggaatgtagcagggatctgaccctgctggagatgggtagacattccactctgcagataaaggcccacagcagataagtaggacttctctggacctgtgcctcaactactcacctggatgttggccacaaatgttgcctccagctgctcaatgttctccaaggtcagaaggggctccagctgggacacatcagcctcaggccccaactccaggctccccatcatttcctgcctggagataggtggcctggtgtcacaccaagccaccaagcccccagcctctgatcccccatgtcccgctgccccaaaggcactgaccccaggtacacatgcagtgcccagtgcagcaaggcgaaggcatccgcagcttctagctcaggccctgcaaggaggttctgcaggctgcggcgcaaaccactatgcagcgtgtgggcccatagctggaccacgttgtactgtggcgggcagcaaggcgctactagtgcctcagctgtggccaactcgactggcagggccactcgcagagcctccagccaccctggtagggcccctggtgcaggcagcagaggtgacccaaagtgggcctgctccaggccctcctgtagtgccctcagacagcgctgacgccagtcccgggggacctggcccaggggggttgttcgtccagtctccacctccgccacacgcacagcagccaccaacagggctgggtcctcccgtgccagcttccctgcggcccctgcagctgcttccacagcctggcccagtgcctcgaacagaaggtccagcccctggaagactggcaactccaggccccccaggggtgcccacgtatcctctcgcagctgctccagctcccgaaggctcacatatgcctccaagaactgttggccatcaatcagagtctgtgtgtgggacactgcagccggcactaatgagagtgaaaaggagacggccctgggtctcagccttcccaccgcctcaatgtgtacagcaggggatactgaggcccagggcgggggtgatgcataaaatatttaacaaccagtagagtaagctgggcacagtggctcatgcctgtaatcccagcacttcgggaggccaacgtgggtgaatcacttgaggtcaggagtttgagaccagcccggccaacatggtgaaatcccatctctactaaaaatacaaaaattagccaggcatggtggcacatgcctgtaatcccagctactggggaggctgaggcaggaggattgcttgaacctgggatatggaggttgcagtgagccgagatcacaccactgcactccagcctgggtgacagagtgagactctgtttcaaaaacaaaacaaaacaaaaaatgaacaaaaaaccataaataaataaataaataaccagtagagtactggccaatctaagaggatcttggcaatgtcctaaagacctggtgggccagaggtcaacccatgaactcatggaatatgaggaagctgaggatcctggagggaaggcaggggaaatcggggggtcctgccagtactcgctcagccactctgttagggaagagtttgaatatactgataaccaggtggccagagtcacatgactgggtgtctgtcctgactcaagcatcccacacgtgggaatcccaggatgagctgcctcataggccatgggaagcccgggctactgtctgggaggtccctggtgtgctgctctatgcagttccccatctagtgccccagccccttgattagggatgggtgtttgtggactgactattggaggctgaggcccagggtccctgcatgctcacctgcccgcagccgaggcagcaggtgagacagggcctgcagttgcttgtgctgggcaacccgctcccgtaggggctctagagtctgtaaggcctgggacatgccctggagcaacccacgggcctggctcagggcctcccgggttccctgcaccacctcaatggcctgggccagctgccacacaccagtctgcacgccttccaggtatgactgcatcactgactgtggaaagatggagccatgaggctgggccagccctgcagcacagtcccagcacccgcaccccctgccccatgcccaccttgaggcgcgattccagggagcaggtacgctgcacctcgcggctgcggtactggcctagcctggccagctgctccggccggtagaagatgcctgaggcccacttgagcgctgcaccccgggccagctgctctgcccgctcctgctctggccactcaggtcctgggaaggaagagcctgggcagccgtgtagtcagggaggagggcccaacgaccccagtcccagctttcttatttatttatttatttatttatttgtttgtttatttgtttattgagatggagtctcgctctgttgcccaggctggagtgcagtggtgcaatctcgggtccctgtaacctccgcctcccgggttcaagcgattctcctgcctcagtctcccgaggagctgggattacaggcgcgtgccatcacgcccagctagtttttgtatttttagtagagacggggtttcactatgttggccaggttggtttggagctcctgacctcaggtcatctgcccatcttgacctcccaaagtgttgggattacaggcgtgagccactgcgcccagccagtcccatctttgttgccatcattcctcccctagtccacccaaaaggttcataccaggggacaacgccggctgcatctcatccttggctgctgagtccattgtgggcctggaggagccagagctgaggtgggcccggggcaagcaggcagagtagatgcccctgtgagctgctgcctctgtctaagcccttctgagaggaggaaggaggttcttcccggccccctcgggaagtgagagggagcgggtgtgatgcggagggcacctgggaggctttgcctgctaggtttcccagtcgtgcccctgcagatgtcaagcgagacagagtgggcacaggcctccactggaccctggtcctgctctgagctgcacaggacagtttggtacagaacttaccagatttgatcaggcgtccagttctccctccaaaaatgaccttggccttgagaacagccctctccccaatgcagctgggcacgcctgccacttgctcacagggcctgggcaactccagctgactccagcgtgcagctgaattcctctccccaaggaagtctctctcccactccccacccagaagccccttcttcccaccgaggctcctccctccccaaggccatcaacagaaaggaaggaagctgagtctctggcattttattcccaacaggaaagagtgtctgcacagagggtggggacagctgggcgacacttccctgaggggcgggggggtggggtgtacttgtactcaaccagtcttgaccagcctacccagaacctcttagtgctcaggagaggagatagggatttgctagacttggcctcaacctggggtggtgggcagagtgtgcagatatggatgcagacgacatcaacagcacaggatgaaaactgtgttggccagcctctgaggaggatgtgtacctctgcggaggagtgagaggtggcaggctcttgtgaagaggggtgtggtggggggtggtaggagagggtcatgaaagctgtgtttatcttttttgttttagacagggtcttgatctgtcaccaaggctggagtacagtggcaccaccatagctcactgcagccttctgggctcaagcgatctgcctgcctcagcctcccaaagtgttgggagattacaggcgtgagtcaccgcaactgggcagctgtgtttatcttgagagttatagggagccagggaagggactataaggtggtaattatttagtggatgttcagtccaccacccaaatccacccttcaggacagaagtgctcattctccagctgccaggagtgtaggctactgagatcacaccactgagtctctcagtcaatattggggtgcaaaagcatggtaccatcgtgtgaacatgaacccttcagaagtgctaccccaatttcagagatcctagtgggataggctgaggcctataatataattgcatctgctcaattctgcttgtcttaatcccttaaaggtgtggatcctgaccaggtgcggtggctcacaccggtcatcccagcattctgggaggctgaggtgggaggatctcttgagcccacgagttcaagactagcctgggcaatatagtgagacccacatctctaaaaaactaaaaataaatgagccgggcatggtggtgcatgcctgtggtcccagctacttgggaggctgaggtgggagaatcgcttgggcccaggaagctgagacggcattgatcttgccactgcactccggcctgggcaacagagtgagaccctgtctcaaaaaaaaaaagtgtggatccccaacaaacttgctgcaaaaccctatctcgagtcccatttcccagaggacctgatctaaaagaaacaataataaatagtaacaatgttaaaagttacaaaatgaccgtatcacacattcctgcatgccaggaatgactgagtgctttactgatatttacacataggtaaacacgtttgcattggctgaagtgttcataaccccatagtctctgagcactgtactgtgaggacaagacgagcgaaagatgaggctaggaccatgggtggaacaaggtggacaaggtagatatagttagtgcttgctgtttggcaggaagtgagggataggaatagatggggtgaccccaagacagtagggcagcctttaggaacaggtttgatgtggcagtaaaatgagtttgaaatatataaaagaataaataaagagaaaaaaatggaaaaggaacaggtttgagggagcagattggattagtcaggtagtgtggtctcctctcccaagatggggactaggcagagttagtgatgttggggcagattggcaaggaaagttccgatggcgtccccttctctactgccagggcggcccactgacgcccttctcattcctccccaacttcatcccaactccccggtctacccaggtagttttcgtcttattcggaggctggacatttgctactggtccctgaagttttgcggctgcacccacagacagcaatagcgccacgttccctggaaggcgcacgggacggaagcggaagcagtaacgctggctccggctgcccggcggccaggaacggaagcggaagtggcggcggcgccggcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggtgcggcctgggctaaggggagacaagggaggctggtggaccaggcctgggccggtagcgggaaccccgggggcggcccagctgggtcctccgagagccggccgccatcgtgtgctttctcacaggagagaagccgggggatgtttcattcattcggccgaggccatcgagctacagctatgggccaggctcgggctgcaggtgttcgtcctcgtggcccttcctggctggcgaggagaagagctgcctatgggacagagctgcggtcctgagctgcagtagcgcctgggaggcactacagggttggaatccagattactcccttcccagaccacgtctcagggtggctgggggtacaccccagagtggggctgagcattctccattctctctgccaggcagctgacaccctagctgtacgccagaagcggcggatttacgacattaccaatgttttggaaggtatcgggctaatcgagaaaaagtccaagaacagcatccagtggaagtgagtgggcatagtgggagggtagtagagtctcccacccagaagtgtcgggcgtggggtggagggtgccgaagaaggcaggggccatgggacccagagttctcagcagtccctctcagccccactccctgggctcaggggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgatatcctcctggcggtccctgctggggggagtgggcaaggggccctctggttcaacttgccctgagtcctgttcctcttgggagtttgtcttatagccactggccatggcccagcctcaggctccctcctcagagcccctccccttccactcttagcctgtgatccctcccccggtggacctgagtccccagaacggtctctgagggcctgtgtgtcagaccttagctaaagaattgggtcttttctgtagtctgccatctgtcaccatagggcatcagccattctccttaaccctcacactttggcctacgtcactcatgaggacatctgcagatgctttgctggtgagcagagcctgggtaggggtaagggggtgggctgggctcagccaaagtcctgagcactgggctcagtgtcttaggagagttctgtctcttaagagggtttctggggcctgctcagagaggaaccaggcagggtaagtcttctgtctgagtgtcactgggaccctgtggaggtcagctataccaaaagggtacagaaattctggagtgggtccctgggtctgttcccatctctactgtttcctggatttggcttcttgggtatgatagaggcacaagggggagagagggagagaggatatgtgtgtatttgcttgtgtgcaggctcttacatgcagggcatgggggtgcccacttccaacttgttagtttagttgcattgtgaatacaggatctgttcctttttttttctttttaagagatgggctcttgctgtgttgcccaggctggtcttgaactcctgagctcaagctgtcttccctcctcaaccccctaaagtgctgggattatgggtgtgagccactgtgccccgctgatgtgtttcttctccatcttgtatgctcctgactggtcatgggaaagggatgttggccttggctagaacaccctcacctagggatcagccatcggtagaggaatgaggtgcctgtggccagtgatctttcactccacataattgaacccagatttcctggttactgaccctgggctctcaggaagagaagagctttagctctgcctggccactatgggggatgggtgaggcccactgtctagttcctcagggaccgtgatctcctgccttgctccaaaaggcaggcacctctgttcccagctcagattgagcccatgggctctgacccattctccatgtcattctaggagataccctcttggccatccgggccccatcaggcaccagcctggaggtgcccatcccagaggtgggtgcttagcccaggcaggcggggtcagctgagggcgggtgctggctgtggagcctgataagtcctgggtggggcaagtagggggaggcctggagtttggggttatctaggaggatgggcatcctgggtgggagaggacactgtggtcctgacccggagtcgggcaggagccaagcctgcttacaattctacccatctcccatcccttaccacccatctctagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacaggtgaggcaccatgggagcttgtgacagaggcccaagaggtagtatctctgtgttgtggaacaccatgctcagagttggaagagactcttcaggttggggattgtccttttcctgaccacctagccttcccttgctatggtaatgaatgagccttttttgtttttgtttttgagacggagtctcactgtgtcccccaggctggagtgtgcaatggcgcgatcttggctcactgcaacctctgcctcccaagctcaagaaattttcctgccttagcctcctgagtagctgggattacaggcgcccaccatgcgcagctaattctcgtacttctaatagagatggggtttcaccatgttggccaggctggtttcgaactcctgacctcaaatgatctgcctgcctcggcctcctgtagtgctgggattacaggcttgaaccaccatgcctgcctgaatgggccctttttaacagggaacctctgactgtgggaagagccattgctggtggcagttttctcccccagatccacatccactggtgtctcaattgccctggtagcccgtcttgaagtatggccacagcagacatgttgaccacgagtcttcttctgtaggtcttgtgtccctgtctcctgtggtgactaatttcaggttacttcctctgggggtgactggcaatgcctaattctccttgggtctgggaaccaggcttgtggtcctcctgtgtctgggttccagcacagccagtttcaacgacctcttcctgaccttgtatgactgggtttgggggctatcattgtagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtggtgagtacctgccccctgggggcagagagagagagtctagcctcagtccagtcctaggtcagaaaacagaattggggatggaacccagatctcctgtcaaccctgctggacacgagagctctctgccagcacctctgggtcagtgctggtgccccctctagcaccccatcctaggctaacacagaactccctgccgtctctcaagccctttcctgccaccccttggagcaccgcctcactaattgacacttctctgtatcactctctctcatcttctctgtctcctttctgtctggactccttgaaaaagtaatctccattcattagtctcctagtcacctttcaggttgcagcagtcacccccccagccccagtgttacagcggtgttactcttgagaagctgccgaaggcctgccgagcccagcagcctccagcgtgttttgctggtgctctcttggtctgtgtcaatattctttcctcctttggcatcatgatgccagcttttggctctcctatctcactggcttcttgaactcttccctggcgtgtccttaaacattgctgtttttgagggctctgtcccattccactcctggagagggctgcagctctgggtgaacgaatccccagcctccgcctggcctagatcttttcccaatctgcacacttcggtgtccacctgccgtcctgtgtacatccaatggacactttattcctgcatgtcctcaactgaacttagtttcctcccgaagcttgctttccacctctgcgcacccagccgtcagccctagttatccaggcctgacccttggctctcactctagttctagttccttatccctcctccttctgctgcccaccccatgccagctaactgaggtctgtcccagatgtcccctcctatcctctggtatcctcagcactcaggatgacccctggccacctctgtcctggattcttcagcatctttctctttaccctgactgacagactaatctttctgaaatgcaggcctgacagaaaaatgtggcatttctctgtttgcaaaagtacctttaatggctccttgagggccaccagataagatctgaactcctgagcctggcatgtgaaatccctcatagtcctctctggttgcattttcttctgcttcccctgtgtcctcctggccagaggtttgtagtggagtcatcaccctgtagcgccaccacctctgcctggtgacctgacccagggtctggtctcagtcttgcacagagcaggtgctcagcaagggtgggacagatggggtaccttctgtcagacagggggtgcatgctgagcccagaaagaggcttctgtggcctttccgagttagaaaagctgtaccaatcgcttgcagggggcctttggtaccctgggctcagcactgaggaattcaggtttagcaagtgaggccaacagacagtgccagcttggcctaggcaggacctacatctccttagctgtgtggagcctcagggtgggtggtataggatccgaggaagccagggggctgtagtggggccaggctggacctctgtgccctgagcatggctttcttgtttttcagttttggaactccccaaagagctgtcagaaatctttgatcccacacgaggtaggctgctgcattcctccctgaggctaggggtaagggacacagctcattgggtcctatggctgttttcttgcccttttgaggaccttgttgtggcgcttatggtaactggggcaaagggtgaagttcctgatgggcaggtggggttccctttcctgggctttggtgggtggagaggtgggagctggaatgttagtaactgagctccctccattcccagagtgcatgagctcggagctgctggaggagttgatgtcctcagaaggtgggtggccctggaaggtgggagtgggtgtgggcaggggttgggctgctgctaggggagccctggcccagggcctgagactagtgctctctgcagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggctagctctgatgtggttctttggggaccctccttgggactgtgctggactggcagtgtgattgggtgggtcaccttgctggaactaggggtggggcggcctccggcagcctgccctccccgcccccacctgccgcaccttggtgtggggcggggccgcctcggcggggcggggcaggcggagccgtcctaccttcctacccccagactccaacccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggtcacccggctggtcccgcctccatctgccccactgccccacctcccggtagccccctggccctcggggcagcccgccccacccctccccccaggctcctccccatccctccctgcccaggccgcgagaatgaccactccacttgcaggcgaagcccctggccgctgtgctgaaggaggtgtgcgacgcgtgagtgctgccgggccagggcctgcggagggcgggagggcaggaggggcggcgccccctgccggcctcgctgagcctcgtgcccctcaggtggagcctgacgcactctgagcgttacgccctgcagtttgcggatgggcaccggagatacatcaccgagaatgtgagtcccctctccccagccccaagctcggccttccgacccctctaacccacctggccccgataactctggctcttcatcccactaccggagcgcgatctgttattcacccccagccgccctcaccgacaccccagttgatcagtcctcggagccctccctgacctcgctgccttttctgctgtcttctccagaaccgcgcggagatcaagaatggcagcatcctgtgcctcagcacggccccagtaatgcccctcccgtcccgccttccccatccctgcccctttgctccaggtccagaggccccccgccccggaggcccccgccccagccctgccttgcgccacctagttgacgcccggggccgcacacttccaggtcccacccttaccatgcccagcctcttcacctctgctcctgctccgttcctgccaggaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgagtgagcacagggatgtgtgggctgggggagatggtgggtctttctggtcctggggtggtcctgctcagccccagatgtcccccctccagcctaggagaggtgctggccctcagcctgagggccttctcagagctcatggagcacggcgtggtgtcctgggagactctgagcatcccctttgtgaggaaggtgggtgggctttcctagggcagcgggtgggggcagtggagcagtggggcagtggtagacccggtcttccatgggggtgaggtggtgacacccccgccccttacaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgtaagcctctggggctggggtccagatgcagggagcagggctggagcctgaatgttccactgagccctcttcttgccataggatgaaccagcagctgcaaaccaaggccatggccctgctgacagccttgctgcagggggccagccctgtggaacgcaaggtgagtgtcgatcggtggctagatgggggcagcacccggtgggcgctgccccaccctgaagcaaaatcctctaagccccccttttttttttttttgagatggagtcttgctctgtcgcccaggctggagtgcagtggtgcgatcttggctcactgcaagctctgcctcccgggttcacaccattctcctgcctcagcctcccgagtagctgggactacaggctcccgccaccacgcccagctgatttttttttttttttttttttttttaagtagagacggggtttcactgtgttagccaggttggcctccatctcctgacctcgtgatccgcccgccttggcctcccaaagtgctgggattacaggcgtgagccaccgcgcccagcctaagccccctttctttctaccccctcagcacatgcttgactatctttggcagaggaaccttcgccagttcatctataaggtaggaagtggtgggccagggggacctctctgcccctccctccccgtgagccctcgcttacaccagggactggctgtcctgcagaacatcatccacagtgcagcaccaatgggcgacgagatggctcatcacctgtacgtactgcaggctctcatgctggggctgctggagccgcgcatgcggacgcccctggacccctacagccaggtgtgtgtctttggtgaggacaaggcagggggtggcttagagcttggccttgaatctataatcttgatcccctcccccgccacccaacactgaccccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctgtgagtatcacccctacccaactccccacccctgcctcagcccagggctgttgttccaggcggccgtggcccttcttgaactgcctgtgcccacttcccccagaacagcaacccagcacaggacctggagcgcgtgccccccggtctgctggccctggacaacatgttgtacttctccagaaacgcgcccagcgcgtacagccgggtcggtgacagggtagggtgggggggtggcagcatcccccaggcagggtccccatgggcttagctgtgactccttgccccattctctgcgcccccagtttgtgttggagaacagcagccgcgaggacaagcacgagtgcccctttgcccggggcagcatccagctgacggtgctgctgtgtgagctgctccgtgttggggagccctgtgagtggcctggactgggcacagcatggccaagagcaggggacggaagggcagagagggccaggggctgtatgcactttctccctgagcccctcctgcccccccactccaggctctgagacagcccaggacttctcacccatgttcttcggccaagaccagagcttccacgagctcttctgtgtgggcatccagctgttgaataagacctggaaggagatgcgggctacacaggaggacttcgacaaggtgggtggggtgggagctgggaggcctgggccagggcagggggctgatctgggtacagagcttaggccctgagctgagcttgggcggccccaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactgtgagtctggggggatggatcctcagtcctagccctaccttccttggtgccccctgggctactccccaggtcagatgtgctcagtgacacccctctatcagggagctgcgggagaagctgaagccagagctcatgggcctgatccgccagcagcgcttgctccgcctctgtgaggggacgctcttccgcaagatcagcagccggcggcgccagggtctctgaatgggcatgggcagggggcagagggcaggcagagggcaggcagagggcggctggcttggtgtcaggacctctcagcactctggccctcttccctttctccacgcagataagctgtggttctgctgcctgtcccccaaccacaagctgctgcagtacggagacatggaggagggcgccagcccgcctaccctggagagtctgcccgagcaacgtaaggcgggcaggggcgggggccagatacctgctctccccagaccgccctgggccccggggctgccagggctgcagtgctcagcccagccttcttcctgcagtccctgtggccgacatgagggcactcctgacaggcaaggactgcccccatgtccgggagaagggctccgggaagcagaacaaggtgagtacagcgggccaggggctccttcccacccgcccccgcctaccctgtcccctgctcagtgtccccgctcccttgcttccccaggacctctatgagttggccttctcaatcagctatgaccgtggggaggaggaagcgtacctcaacttcattgccccctccaagcgggaggtgagtgtccgccaggctgaggtcggcaggtgggcaggggaggcagatgggcagaccctcacggctctgtgccacccccagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttgcgggctgagcctgtgacagtgacagtcttccccttctgccttcaaacttagctggtggataagatggggcatcaggccaggccacaaactttgacagctacggttgaggggctggtgttctgaagggggtggggagaggctgggactgcagcctttctccaaggtgagtcctcagcctccctccatgctgggcctgcagggagggttggcctgtggtctgggggcacctgccaagggagaggctgagctgccggcctgctgcaggagaactggcagggtaggaggcactgccccaaatggatgccttcctggacagcgttaacaggggcgtagtctgggagccatctccagaaggctcctgacaatctgacctcagtcctcaagcttgcatggccctgcctggtgtcctttgtaggacttggagttctctggtgagaggcatgaagggagagaggcagaagggcagggtcaggatccccaggctggtaggaggatgtgggctgattccaacaagagccacttctgtgcaggaagacccggtttctgattaaaacctaactcagggccgggcttggctcacgcctgtaatcccagcactgtgggaggctgaggcagtccgatcacctgaggtcaggagttcaagaccagcctgggcaatatggtgaaaccccgtctctactaaaaatataacaattagctgggtgtggtcgagcacacctgtaatcccagctattcgggaggctgaggcaggagaatcgcttgaacccgggaggcggaggttgcaccgagctgagattgcaccactgcactccagcctgagcgacagaatgagactccatctcaaaaaacaaattaaaaatctaactcagaaccatgggtagggtgggggccatagacaggccagagcccctgggggcagaagcatcgaggagtattgggcccagctggaggtttggtcacaggggcagaggctgtgatcacagaccccaagcccgtgaggaaagaagagcctataagtctgtggagctcacaggataggctgaagccactgcccctcagacttccccctgccattcacctcttctctcaccagtgctacctccaatatcttttttttctttttctttttcttcttttttttttttgagatggagtttcactcttattgcccaggctggagtgcaatggtgtgatcttggctcactgcaacctctgcctcccaggttcaagcaattctcctgccttagcctcccaagtagctgggattacaggcatgcgccaccatgcctggctaaattttttgtatttagtagagacagggtttcaccatgttagtcaggctggtctctaactcctgacctcaagtgatccacccacctcggcctcccaaagtgctgggattacaggcatgagccaccgcacctgtctccaatacttttttgtttgttttgttttttgtttgtttttttgagatgaagttttgctcttgttgctcaggctggagtgcaatggcaccatcttggctcaccataccctctgcctcccgggttcaagtgattctcctgccttagcctcctgagtagctgggattacaggcatgcgccaccacgcccggctaattttgtattttttgtagagaaggggtttctccatgttagtcaggctggtctcgaactcccaacctcaggtgatctgcccacctcggcctcccaaaatgctgcgattacaggcgtgagccaccgtgcctggccccaatactgtttttaactgttaaccatcaacctggctgaccttgagaactgatgaaactcagtttcatccctcagtgctcagccctcagtgctggagggcacttactccccctcccccagctaagctgcagatctttgggcatccagggcccactatgcccatgcctaaggacttcccaccacaaatggagcagtcggccattgagttataggtggaaatggggggcagggacccctgatgctgtcggcctccctgtaactgtcaattattccttcttaatgtctccagtcccttgtgcatgccaccatcatagcaaaagcctcctgacttctggcctcctgtcttgcacttccaatcctctcaataccagctaccccaactgctttctccgacataaatctgatcatacacacacacaaacatcccatatatttgatgtcaccctatccatgtccatgggttaatggccacagtttccatggctgagcctgagttgagccaggtgagtctcagacataccgtggtttagcccttccacctgagcacctgtggcttgcagggttctcgatgcttggtctgagctggcatcctccctgcctagactaccccctcagtgccagctctggcctgcctgtgtgcgtccccacagtgccttctacctggatcacccccttcctttcttctggccattttcactgccctgattccttcctggaccctccaggcccaatttgttgctccctgggctctggtcccaggtgcttgtctctctcttcacccgcaccctgcacactggactgtccctgctagctggcttctctgcctccccagctggccctggggctgggagagctttggcccctctgaatccccacataaagcacagtccctgcaggtactgggggagccctggctcgctgctacaaccaatgaacagggatatagacgaggtgcggggacacaccaagggccagacctgccatggagaagtcaccagcaccattgagggggctggattaggtgacctctagtgaccccctcacccagagatgctggcctctttcattcttttcttcttatttccccctcaggacagcctcattgactcaggcatcattcatcagttgttcctggaatctggctgggacaagcgcacagcatgtacctttgcctcagggcacacccaggcctgcagggtctcctactgtgtggggaagatgctaggagcccctgtggggctgtgggccaggcctgaggaaggagcgtgcctcagggttttctccgcctgccccagggccacttcagctgaagctgggaggggaggggccctttagtctgagaacttaagacaaggaggtactatctggaatgtttaatcttaggatttacagcacagacctaggctcagctgctgaagctcagtgcacacagggtgctgggagagtcccacaggagtaggtggagcccggccttaggtctgagaggagggcaggcaagaggcagaggctctgctcctcccagcaccagaccctgcccgctgggggcctggcctcccacccagggcttggccagagagcaggagcctgtggcggcaacacgtaggtagcatttccaggggcctgtggcagcgacgtgtagctggaaagaggctactgccaggcggtgtggcaggatgttccctctgggctgccctggattggccccacccccagtcctagagggtctgcagtagagggaggcaaaaagcaacccgggtcaaggccagggttggagactgggggagtcaaggaggctgtgctgcagggctggttactgacctggcctcagagtgttagggtcaggtcagcccctcccacgaagcgggactggacacaggacacctggggcagctgggcttggaagcgtctgacggcggccatgttgatgccagggcacgtggccacatccaacacccggagctgcctgcacgcctgcccaatagcatccagtgtcctgtggggaggccacctgatgagtgcctggcccggtgtgggacccagcccagcccctgcaccgtggctccatctgcctggtgtcatcggacacacttactgctctatgagctgactgcagctggacaggttgagatgctgcagccttggccaggagctggctgcctgggcccagcccttgtcactgagtcggctgcagtgactcagcgccaagtgctccaggctaggacagcccctggccacagcaaccaagccgttgtctgtgagttctggcaacaggctaagggacagctgcctcagctggagaaactggagcacctacaaggatggggagggtaggggagaggtaaatgccactggagcccacagccttggcctttccagatcctcccaccccagccagggcgtgactagaggcagcagaagccaatgaaaaaggaactccaaggtcaacttttttccaagcaaaaagtgggttggcccagacccctgacttcagcccccagatcctcagcctacccgcacccccagccccacaccttggctaaactggcatcagtcagcttgctgcaggctgtgaggtccaactcctgcagggcccgcagcgtgagcagggaggggccctgtggctctggacaggcgtccttggtacctgaggcctgatgctccagctctgggcgtgactgtgggaagaagcctttgcttctcaggttcctcctgagtttgcccttaaatactcctacagagacttgggaggggcaggagggcagctgatcccaggggccaccccgtcctccaagacctcgagggtcccacacctgggtcccctgcacaggctcccccagcccccgaagcccccagtcacagagctccctgcaccacgccaggcgcaggactgagaggtgggtgaggtaggtgcagatggcctgcagggtcctgttggtgagggccacacaggaggacaggtctagcaccctgaggctcaggcccagtgctgggatcatggagagcactgaggcatcctaggagggaggaagggaggagacaggatggagcaccagctggttgcctatgccacctggcctggcaggggtagctagaaagggtctgttcaaggttctcaccccacaggcaggagggagctaccagagggtccaaggaaggaagaaacatggtccctgtgctggtagtgaaagttgggggtggacagggtgggccatgggggttgccacaggaaaaaggcctggactgtggctggggcaggaaggatgcaggtggcaaggcctagggtggccaccctgcctatgctcccagcccctgccaaaaaagtgaatgaggccacctcagaccacagctcacaactggaccagccagttgaccctgctaagccaatcggagttgctccctctagagctggacgcaaaacagtgagatgtaggtagagctgccagctgccagagcagttagggacggggagcaggagctaagggcagagtagaggaggctggtttgtagagagatgcacagaggggagcttcagggacacaagaacttgaggcctggaggcagcagctgagaggacacggggatgttgtactacatatctgacgtgcttggtgccaaagaggaggagtaaggccgggaagagaggcgcttggaggggaacaaggtggagagacggtttttaggttgggaatgccctggtcaaatggacaggctgaagaaataatccgctaaagagggacagactgacactgccaagacaggggtgccacccagagggacagcgctgagccctgctgacgggcctggccttggctaggaaatgaccctgctgctcctgtcacatcaccctcgcaggccccgccccagcaccttcctcagtgctccttccctgccttccttgcccatcaccccctttcttcagcccgcccagctccagaacactcatcctcagcgcccctccccagactgcagcggtcgccacacacttgacatgtcagctgttggctgcctcgtgggctgggccaccttggccacttggacctcctaggcccagaatggggggtttgtggggggtgtgctggcagcaacagcagctatctaggctcttgccctcctccagactgggtcccaagttcatttctaactgccaatcataggcatgaacactggggagtccctccctggtgccaaaggccccccaccaccccgcttcccctctcccgctgtcctcagccctggagaggaaggaaggggatgatggtgtgctcaccttcaatgaagagcagtgggccaggctgagggaggccagctgggatggagccccgtgcatacagcccagggcctgggccagttcccgccctcggccatgtcgaggctctgcagctcctgcaggccacccagagctgtacatcctgcatctgtcagccgctgcagcttccccaggctcaggcgccgcaggtgccgcaggccccggctcacggccaagagcgccccatcagtcagttctgagcagccactgaggtccagggaggtaaggcctggttgctggaagcacagggtagccacagcctctgtggagaggtcccggcagctgtgcaggctcagctcctgaagctgcagcccagctacctggcccagagcctgcagggcctcggggggcaagccagtgccactcaggtccagggcacgcagcctgccagcccgctcttgcactaatcgcagcaggttgcagaaggagaactgggcgggagaggagtcttgggggccgatggagcctcaggctgggcctagctcgaaggtgaggtggcagtatgccaaggagaggcgctccaggctgggggcacagctgctgagctggttgaagctgaggtcagccaggtctcgcaggccagccaggttgagctcacggaggccgctcaaagcctgctggacgctctgtgccatctctggctgagccagcagtgtgcccgaggtgaagaggctattgcagccactgaggtcaaggacacacagggctgggcagcccaggatcagggccacagaggaggcctctgtggggctgcctccacccagggacaagctctgcaggtgtgggcccaggtggtaagcaacagattgtagcacctggtgtgaagccagagagccatccaggttggtcaggctgatgcagcagatgcccctgaggcccaggctcttgatggccgagagggaggcagaggacacggggatgttgtatcgcacatctgtctacggagcagcagcaggcctgggggtagccctctggcttcagagggtgctgggcattgggtttggtgacaagtcactggccagaggttgagggcaggtcaaggaagggcccttccacaatggagacccaccatggtgtgtggtgtcatgtgtggtcaagttgggtatgggtaggaagtgggagctggggttcaaaggagatgaccatcagaggaaggcgggaaggttagcgatggacaggatgggatactgagggaggggtggagacagagtggggagttggcatgctgagcacaggagggctgagatgtgacctagaggaaacccagtgaagtccccagggtgtgggagggcaaagtatgccagaccccaacctttgggactttcagaaggaggccctgagatccatggactcagcctcctactccagggacttggcatgagctaagcagccagcctcccccactttctagagagcgtagccctctgaagagtggaaggcgatagaagtgaggtaggtgtcactcaccacaaccctctatggcccaggtgccagaggtctggggcaggcagtgaggcctaagtcccctggtggcctgagagagcctgtcacatgaatgtttgcaaaaatgtgttctgtgtgtaagcaaaaatgtgtgcatgtgcatatatgtgtgtgtgcatgtatgtgcatgtgcatgtgtgtgtgcatgaacacgtggagctgcctggtattgggccccggatgctccagagttcaagatgtgcttgtgatccctgtggcatatctctggagggggcatctatctgtcacggtaaggacgctgaagcctcccatttccgtgggtgggagctaacagaacacacctcacccgtgccaaggaagttgagctggctctgcgtagaggaacaggggagtgataatggggagtgcacagctggagtcaggtgggacccaagagaaaagctcagggctacatagtgggaataagttggcttgtgcaggcatttaggagctcccagctaaggagatatcttcaaagaacttttcctgatattgcactggagtgagccaaagggaaatcggtataatttgtgtggaacagatctctggggagagggagaagagggcttggattctaaaatccttgccccatctccctacctcttgcccatgttgcaggcacgtggtactcaaagagggctcttgtttgaatcaacatggtcctgatgcaggaaagaatcctcccctaaacctgtcttgtcagtaactgcaaaaacaagctgctgttccctgctggtaccccacagaccatcatcaaaagggaatccaagccaggcacggtggctcctgcctgtaatcccagcactttgggaggctgaggcgggtggatcacttgaggtcaagagtttgagactagcctggccaacatggtgaaaccccatctctactaaaaatacagaaattaggctgggcgcggtggctcacacctgtaatcccagcactctgggaggccaaagtgggctgatcatgaggtcaggagatcgagaccatcctggctaacatggtgaaaccccatctctactaaaaatacaaaaaaattagccgggcatggtcgtgggcacctgtagtcccagctacttgggaggctgaggcaggagaatggcgtgaacccgggaggtggagcttgcagtgagccgagactgcatcactgcactccagcctgggtgacagagcaagactccatctcaaaaaaaaaaaaaagaaattagctgggtgtggtggtgcatgcttataatcccagctacttgaacctgagaggtggaggttgcagtgatccaagattgcaccactgcactccagtctgggcaacacagcaaaactccatctcaaaaaaaaaaaaaaggaatgcagaaggtagaagtgactcacaggatgtgctcctgcaagatacttatcaacaggattctcctaagaaacacaggactcattcccaggtgtggagaggccagcctggcttctaccacagaaaagtggcacccatggctataatgacaggaaggagtggtgtaagagacaggaaccagctcctggcctctttcacaggaaccagaggtcagccaggttccccttccagcccctacttctggaacatggtcattccagatgagaggggcactcaccacaggtctcctcgtgggcaatggatcggggatctcaggtgaaaggtaggctgggaagatcccagtgtgtgagggtggagagggcaataaaacatcagagaggaatggagggcatacctccagccattcccaagccctgcaagctgaacgactccatcccatgcagatcagaggaaactggctggggcaggtggggcagagctggctgtgaggcagcacctcctcccccaagtcacacatcactgaggaacccctgaaagtcctgcaggccccagctccagtggcacagcaccttcaggggctcagcctgacttctttccttcccttcattctggagcctggctggccaggaagggtctcttctctcccactgcctccctatgaaccaggtggacaaaagaccttggaaggctctggcaatgccccagggcccaagtccagggctggctcctggcagcaaggccactcgataaagaagcagagcctggcttaaaggacttctagctctgggggtacggaagaggcttgagaccatgtccaggccccaccatttttgcaggtgggatgggagcagcctctaagccacctcccaggtggctcctgaggtctgctcctgaggtcacctgctcctgaggtcatatggacttaaaactgcaggagttggccaggtgtggtggctcatgcctataatcccagcactttgggaggccaaggcaggcggatcacgaggtcaggagttggagaccagcctggccaacatggtgaaaccctatctctactaaaaatacaaaaattagctgggcgtggtggcaggagtttgtaattcccagctacttgggaggctgaggcaggaaaattacttgaacctgggaggcggaggttgcagtgagccgagatcgcgccactgcactccagcctgagcaacagagcgagactccagcttaaatcaataaataaataaataacctgcaggagcccaggaacagcctttcagggatatttctctgtgtgagagaacagcagcaggctgaagcaggccttctgggttctggactttggccctggtataggacacccccttcctgggccctgggaagatgcttctagacccacccaaagagaactgcaaggccacatgctctagctctagctgccccatctacagaaggaacaccttgccccctggtctcctcccttcccgatgctggcatcttaagagtaactgctggccgggcgtggtggttcatgcctgtaatccctggactttgcccgaaggcgcgcaggtcacttaaggtcaggagttcaagaccagcctggccaacgtggtgaaaccccatctctactaaaaatacaaaaaagccgggcatggtggcagacacctgtaatcccagctactctgggggctgaggcaggagaatctcttgaacctcagaggtagaggttgcagtgagccaagatcctgccactgcactccagcctgggcaacagcgcgagactccatctcaaaaaaaggaaaaaaaaagagtaatcgcaatatcatttgggaactgctctgaatctgctacaagtaacgtatgtaccttttctgtgggagaccagggttttgttgtacctaatgaagccctgaaccgagactgcaggcctgtgtacagacttggaaagccatgtgacagagaaaatggcccttcgtcctgcctaatacaggactccaaagctaccgtgcttgttctccaggaggccgttgggaaatgtacgccctggcacccagggcattggtctctagagaggagttagactagtgggtcatacagaggctgctccaggacttcatcaatccctcaggcagggagggcacaaagagctctcttcagctattgcttcatggggaccaaccagcagagacaaccagggctcccccaggaacggacagggccggtacatatggagggtgctgcctttgccggcatccttatttgagaaaattgggattaagggaataggagggactggtcagggaaagtaagtccccaagaccagcgtcctagcccagcttggtgagtcaccagctctagctgggcctcggtaagccagtgtcttccacagcacctaactggtacctaactgctactgcctcagtatccacctgcccatgcccgagccctgggagatggttcctgcctgcagggtcccgcaggcgctctctggcacatggtaggggtgatgccaggtacctgtggcctggcctcccagtgctcccagcctaggtggggctgagtttcgcagaggcaccaaagggtctttgtcaacattccttttttctttttcttgtttttggttatcccaaggctctgtcatctgtctctgtccgcattctatctggagagcatggttggctggagcagctcccgctctaaaacactcactctggcttccttctccttcctccagccctgcccaacttgggctcctctgactgccccatctttgctgggttccatgaggctttgccctgtgacaacctctcctcggggtccttgttgccctgcctcagtcgtgctgctgtgcccattctcctggcccggccagggctggcaagaccagctgcctcctctgagtctgtaccagggatacagaactccgcccaggaagtcatggcctccttgctcgattcccaccctgccccaagacttctctccaagcccctccctctccagctcctggccctactgatacaccctccctcacccaggattctcagggatggccatcaagtgggaagtccctccctttcccctgttcatgtccaccagctgcctccaggcagggcccatctgaaccttcctccttctcctgctcttttgcttccagaagacttcttctcctggcctccttctcctgctgcaccttctcctctgagaaccctgatgtttatgcctttccactgctccttcttcagaggccacaaacaccccagagtcttaaactgcaactaaaagcctcctttcatcccgcaccccttcctcttgcctctcttctctccccttcctctacagccacgcttcttggaagcacacaggcacaggcatgcctgctgtcccgccactcgttgcccctcgcctcacctgctcacccctccaccctggcccccacaggatcacgcattcctggcaacaactcccctccagcaaggtcaccaacatgtgggggcttcacctcagacctcccacaagggttctctctgccatgtcacctgctctgcatggccagcagccactccccttgatgccatctccactggggttctgcaactctgcccccctggctttcctcctaccttctagcctgctcttcttcaggctcttttggggtcaacaaagaacagagatccagtccacagatgagtgggttccccatggtttgttccacccaagaacacacacacgtgtgcacgtgcacatatgcacacgatctttgtgcccctccgagtgtaccctggccaactgcattttgccccatggggccatcattccaaccactgtctttccgatccacatgatgttcctgaacgccagaccccgggagccaagtgcctgactggcctctctccagagggcacgatgcagcatacccaaatctgaactcatcatctcatcctccaactctgctccttctaaactctccccaccctctattgagtcacccaagtgggaaatttgggagtgattctagaatcctccctcactccccacatccacaatgacccaagccccttccacttttgtttccctgatacggtgcaatctgtccctctgctccaacctcactgcttctgccctagttgaagtccccatactgtatgccagcagcccgagagctgcttcctctaagctcagaccacgccagcttcctccttatcaggtcctggcctccagttcctctggctccaatccatcctgggttttgtcaccatgtgacccttccaaaaggcgattctgcctgtgctctccagaccctctgccagttccgcacgcctccaggacacaggctaagcttcctaagcctgcattcaagcccttctaggacccaggcctgctgcttcagccaagctcttcccaagcccgttccccttcctcctagtcctggctctggggctgccacttctgaccattgtcctgtaccgcacgcctctgctcagctgctttttctgttctgggggggtcccacccctcactggctcctattggtctatttggcaaatgtttattcctctctcgagtctcaggccaagcacctccttctccatggagtcttttctgatcttttctctgcacccatgatgtgcctcacacagacttcaaatgcagcaccccagcctctttttactcatctgtactcactacacactccccagccctgtgccttcctcagttttgcctcgctggtgcccagcacactgcccggcacagcagaaacatttgagtaaggctgcccacaccctctctatgtgtctctggtaattttccatcttcctcctgtcctgtgactgctccaaccctctctgctgaagccctggcctctatgtctctttttactctcctgagacaacctggtctccaaatccactgagtgaaggggccgctgaggaaggagatgcctctgaggaacttctctgcaaatagctccatgtttccacccccacctctctgcttcctcaggaagaggtgacatcctttttttcaccaaactgatgctgaaaaaacaaaaaagaaaaacacacacatacacacacaaaaaaacaaaaaaaaaaaagggagaggtgatatcctctccatcctatcccagatcaagcttggtatgtggaagcctgtccctgccaccatcttctacacctgacctctctcctccccgaatcttcacccctcctctagtgactccctgaagcatttatttatttatttaatttatttatttactttttttttttttgagacagagtctcactctgtcacccaggctggagtgcagtggcacgatctcagttcactgcaacctccaccttccaggttcaagcgattctctgccttagcctcctgagtagctgggattacaggcacctgccaccatgcccggctaattttttgtatttttagtagagacggggtttcaccatcttggccaggatggtcttgaactcctgaccatgtgatccacccaccttggcctcccaaagtgctgggattataggtgtgagccactgcacgcggcctctttttttttttttttccttttttttttgagatggagtcttgcccagactggctggagtgcagtggtgcaatctcggctcactgcaagctccgcttcctgggttcatgccattctcctgcctcagcctcctgagtagctgggactacaggcgcccaccaccacgcccagctaattttttgtatttttttttttttttttagtagagatggggtttcaccgtgttagccaggatgggtttttcgttgtttttttttgaaatggagtcttgctctgttgcccaggctggagtgcagtgacatgatctcagctcactgcaagccccacctcccaggttcaagtgattctcctgcctcagcctcccgaagagctgtgattacaggcattcgccaccatgcccagctaatttttgtatttttagtagagatggggtttcaccatgttggccagggtggtctcgaactcctgacctcaattgatctaccagcattggcctcccaaagtgctgggattacaggcttgtgtcactgcaccgggccaccctgaagctttatttatttattcatttatttatagacagggtcttgctctgtcacccaggctggagtgcagtggtgtgatctctgctcactgcaacctctgcttcccaggttcaagagattcttgtgcctcagcctcccgagtagctgggattacaggtgtgcaccactgcacctggctaatttttgtatttttagtagagatggggtttcaacttgttggccagactggtcttgaactcctggcctcaagtgatccaccagcctcagcctcccaaagtgctgggattacaggtgtgagccaccgtgcccagtctcctgatgcattcaaacacatttcagatttctccagaagagaatccctttgtctttgtcaaacccatctcaacttctcatttctgccctatttctttctctctctctctctcttttttttttttttttgagacggagtctctctctgttgcccaggctggagtgaagtagagcaatctcggttcactgcaacctccacccctgggttcaagtgattctcctgcctcagcctccagagtagctgggattataggaacccaccaccatgcctggctaatttttgtattttagtagagggggtttcgccgtgttggccaggctggtctcaaactcctgacctcaggtgatccactcgtctcggcctcccaaagttctaggattacaggcatgagccactgtgcctgacttgccctatttatttccttctttctgtagagaaatttcttttttttttgtttttttttttttttgagatggagttttgctccagcccaggctggagtgcaatggcacgatctgggctcactgcaacctccgcctcctgggttctagcgattctcctgcctcagcctcccgagtagttgggattacaggcatgcgccaccacacccagctaatttttgtatttttagtagagacagggtttcaccatgctggtcaggctggtctcaaactcccaaccttagatgatccgcccacctcggcctcccaaagcgctgggattacaggtgtgagccactacgcccggccaagaaatttcttgccagcgaggtcacgctctacacttcctacttctctcattcactcctcaatccacctggcttatttttccagatgccaaatatcactgaagccattggtggcctccttggataacatatctcatggacaatatttgttcttcattttgctgggctttttgtgggatctgacattgttaatcatccattcaatcctttatttatgtatttttttttgagactgagtctcgctttgtcgcccaggctggagtacagcggctagatctcgaatcactgcaacctccacctctctggttcaagtgattctcctgtctcagactcctgagtagctgggactataggcgtgagccaccacgcccggcctcattcaatcctttaaatgctctcctgctctcctgcctttgacgtctgtgccctcctctctctgagagctcctcattcccctctttgggtatctcctcctttctgtgcccttggacttgtgtcctctcctggggcttctctgtggcctgctgttctgtggctctgcatgttctccccgggggaagttactcagatctgtggcttcaactgccacctattctttaatgacactcaaatctatatttattacccagatatttctcttgaattcctcactcagaaatgcaactaccaagtggatctcaacatctagatcctcacacttcaaactttcaacatgtccaaaataaaattcctttggacagtgagatgaatgtcactgtatacataattcaacaaaagaatctacttatagactcatatttaataggggatagaggattccaaccaaacagagaaggagaagattagatgtaaatggtgttcgggctctttgaaaattaatcagtttagcttcttacctcataacataaatctaaataatttttaccaataaaaacattaacacaaaaattcaaaccagaaagcagaagagacagttttgctgtaaacctaaaactgctctaagtaatagagtctatttaagaaaaacagaagaaaagtgtaaaagggcaaggaatcattaagtttagaaaacaatggaagaagtgaaaaagaaaaggatgttcagaatcaacaacagagaaatttaacttctgggccaggcatggtggctcatgcctgtaatcccagcaccttgggaagctaaggtgggcagatctcttgagcccaggagtttgagacgagcctgggcaacatggtgaaatctcgtctctgttaaaaatataggctgggcgtggtggctcacgcttgtaatcccagcactttgggaggccgaggcgggaggatcatgaggtcaggagatggagaccatcttggctaacacagtgaaaccccatctctaccaaaaatacaaaaaaaaaattagctgggcgcggtggcgggcgcctgtagtcccagctactcgggaggctgaggcaggagaatggcgtgaacctgggaggcggagcttgcagtgagccaagatctcgccactgcactccaacctgggcgacagagcgagactccgtctcaaaacaaacaaacaaacaaaaaacatatatatatataaattagccaggcatggtgacatgcatctgtagtcccagctactcaggaggctgaggtgggaggatcacctgagcctggcgaggtcgaggctgcagtgacctgtgattgcaccactgcactctagcccaggcaacagagcaagactctgtctcaaaaacaaacaaatgaaatttttaaaaaattaaatcaaattaaaattttaaagagaggccaggtttggtgactcacacgtgaaatcccagcactttgggaggccgaggtgggtggatcatgaggtcaagagatccagaccatcctggccaacatggtgaaaccccatctctactaaaaatataaaaattagctgggcgtggtggtgcatgcatagtcccagctactcgggaggctgaggcaggagaattgcctgaacccgggaggtggaggttgcagtgagctgagatcatgccactgtactccagcctggtgatggagcgagactccgtctcaaaaaaataaataaatagaaataaaaaaagaagcgcggcacagtggctcacgcctgtaatcccagcactttgggaggccaagtgggtgcagatcacttgaggtcaggagttcgagaccagcctggccaacatggcgacaccccatctctactaaaaatacaaaaattagtcaagtgtggtggcacacacctgcaattctggctacttgagaggctgaggcaggagaattgctgaggcggaggttgcagtgagccgagattgcgccattgcactccagcctgggtgacagagcaagactccatctaaaaaaaaaaaaaaaaaattagctgggcatggtggcgtgtgtctgtaatcccagctacttgggaggctgaggcaggagaactgcttgaacccaggaggcagagcttgcagtgagccgagatagcgccactgcactctagcctgggcgacagagcaagactcttatctcaaaaaaaaaaaaaaaaaaaaaaagaaaaagaaaaagtccatacaaatggaatagaaaaatactaagaccttaatagttaaatggatacagaacatgaataaacaaaagggggaaatatgaagggtgaactaatgagaaaaacagtgcaacctcactaataaacaaatcaaaattaaaacaatgagccatcactgcctgcctttcaaactagcccagatgtctgcattcacctcctggctggcctcctccctatgctgtctcactctcccagtccactctgcactgcagagttctaatacaaatcacgctgtgtcacttgcctgcctaatgggctccttgatggtcaccaggagaaagccaaactctgctgcctggcacatctgccagcttgcagcctgatgccattctagcctcgcctcctgccatgtctcacttagttccagccaaatggaacttgtgtgattggttccacaccatggtgccttcacttatgctattactgatcccagaagcccaacctttcttctcatcctgttccttcaggaagccttccctgacaccaccagtctcctctggatgtccttcttcatgttccgtcaaactctttttttttgagacagagtctcgctctgttgcccaggctggggtgcagtggcgcgatctcggctcactgccatctctgcctcccgggttcaagcgattctcctgcctcagcctccaagtagctggaactacaggtgcacaccacgccaccacacccagctaatttttgtaattttagtagagacagggtttcaccatattggtcaggctggtctcgagctcctgacctcaggtgatctacccgccttggcctcccaaagtgctgggattacaggcgtgagccactgcgcccggctgtccccgtcgaactctttcttcccagtgtcacagcgctgagcacacgatagcatgatcattcatattactcgtctttctccttcactggaatgtgagctccttagggaactatgtcttatttatctgtatagccccagcactgtacccagagccaagtatgtatgaatgtatgtatatatgtgtatgtatgagcatatgaatggatggatggatggatggatagatggatggagatacatgagcagggccacgagtaagctgaagtaagaaacacctgaggatgggacgggggagggtgggtgccttacctcccgaagggcattctgggcagcacggtaccaagcccaactcacgagggaggcctctttctgatctgacagaggcaggaagctcagaatatatgtgagcatctgagggaaaaagacagggcattggggactgttagaggtgggaggtctttggaacccactccagctgacagcaccatgggtctgagggcaccagagccctggcttctactttatcttggatgtgaagcttcacgaagcattcacttccccgctccaggcttcaggtatctttcctgtaaacaaacctttcctgagctgggtgcaggcttgcactgactgataagaatcaaacttcctgcctagctgggtagaaaaagcctgggcattgaggccagataaacctagttcaaatctctactctgccaactgacctctcgaactttgttttccttatctgtgaaattgcaattgtagtgagatttaaatggattattgtgagaattaaagaacacagccaagtgtcttgcataggacctagagcacagcaggccaggtgtgctcactctggtcctcaggaagtcatgcttggtcctcctgccctcatggctcaggctctgggaccctgctgtttttctgtcttcttcactgccaccttgccctctccactggttgttaagatgcgctcccagcaagacctagcctgggaggctcaggcccttccccccacctagggggtggtgaggttagaggtcctaaatgggactggggaaggggttaccagtgaggcctagaatgatttgatattaactcttcttttcttctggaatcttcctccctgcatcccaattgtctcgtttttggattcttctgtggctcccagggctcagacctgggtcttttggttttctgtttaccaacacaggaataaccaacaattcaatattcccatattgtcctattatccaagtgctagtccatattgccaactgtccatgcaaatgtttagccatcactttaatctcaaccaaaactcatgttctaccctcagcccaaaacagcctctcctcccaaattcccctttcaatgccaacagtgcatctacctgataacactttcaactattcaaaccattctgtcccttcctcccagatacaggtgtaatgcacaggctttaggccaggctaacctaaactcattcaaattccagctccactacttccacatatactgatgtgtgaccttaaacaaggtacttgacctctgggagtttcagtttccatatctataaaatagggatactttaaaaaaatctagatcatagcctcatggggattaaattttacatatatatagtgtgtgtgtgacaactagatgttccataaatggttgctggattgctgttactaaaatttctacctctgcaacttccccacctcagtagctcagatttctaccaccccaaacctggattccttccacaatctcccacctgaactctttgcctccaagttcatccttgctaatacattatgcacactgtcacaaggttaatttttcctataaaacagttttcagtttcagctcacccctgctgtaaaacttcagggttcacagtactctcaggacagtctccactcctggatcagcactgccaggcctctgtgcctgattggactcgctggtccccaaacttccccagtccagtctccccattgccctacgcacacagcatgtctatttccttttgcctatgcgggccttttccctgggatccccttcttgaagcttaacttcaccaacccattgtgatctctccttcctttctcagatgccaagcacgcaggcacagtgctcagccagtgcttactggattaaattaaggttggacagtccagtcctctacctctattttcaccaagagtatgctcagggaaggggtcggggaaataaagcagtcattactgagaggacaatgactggcagaatagacttctgggccaggaagggaggcatagggaagacagtattgatggggactgggactgaccaagtcccaatccctccagggaggcacggaagcctgtttgagctgagttaagacagtggccatcctgtcttctggggctaagcagccagcccaagagcaaagggagaggggaacaaacctgtcatcccttggggtgagtcgggaagggacacaattcattgacctaagaagagggtggcctttctagagggacaagaggaggcagtgatgaggatggagtgaccatcccatgagtcccatctcaagggggctactggagataatgattggtcactcatggggtctatggggatggaaatagatagcccctaaagctaagggggaaagggatagcactgcaagctcaataggggtgggaacaggcctatttttgctaaggacaggagcatcattccaggaccgatgggaaagggtggcctgtttcccatgggcagagagagggggctgccaaccctcaggacaaaagagatggagaagccattccaacaggccactgaagacaaaacctgttatctccctggcagatggggcagagtggtcttgcccctggctaaggggaaggagcaaacatcccacggagtgaaagaggtaagggcggccatcactaggggcctaggaatggggaacaggcctatccttgttaaaggaactcagagatcattgcagttgatggggagggagcagtctgtttcccactgccagggagaaggggcggccgtctctgtaggaaatggagagatcatcccaagggaccaatggggataagatcagttacccttcgggacgatgagatggagcggacatcttccagaactgagcggggaggagacagccacttcaagggaaggggatgggcagagggcctgttctcgcggagatgacagggcagctatcttctggggccgatagggaaggggaggacggtcccccaagctaaagggacagagtggcccaaaggaggaaccgttacccagagctagaaggtcccgggatcgggagggcgggtcgtttccgccaggctggaggggccgggctagctatctgacagcccctccccaaagctcaggaccgcgagggcggggcctgtccagagctaggcctgagggcggcttcctctcacctccaggggcagcgactccgccatcgcatccctgccgcctccgcccccactgcgcaaggctttctgggaaatgtagtctcgcctctttggggcggggcttgggaaggaagtgagacctatttccgtcgcaaaagctgacgacttcggtctgcgccggaagtgcatgagctgccgatgtggtgcttagtgattgcggtttcggtcgctctcccgtgtttcccgggctgggtatttgcctcgcaccatggcggtaaggaggatggatagggcggggtccgcaccagcaaagctctccaggggctgtgagagtgaaaactgagaaagaacattaagggatatggggtgggccagagcggggcgccatccctggccagaccgtgctagagctgggctggggggatggcggcgcaggaccataccaggactagtgccagagcggggtgggcatcagtaccagggcaggccagagatctaagtgacctgaggtgggggttaacccagatcgggactacgccagcggaggcctgagagaggcaccattcaactccgctcaggagtacccttggaagagtcgttagcctaaagccagactaccacgggatccagaggcggtattagcttaggattgaattgttccagggcgagcaagaggcgattgatcctagctgcgggtgctggagagatggcgtcagccctaggcagaatggactggaggatgggtggacatcccagggattttgctaggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgtaagtgcctacctccttgcttctatgcccacttatagtcagttccctagtcctcagccctgcttggtgacgaggagtggtacccgaaaaagctctagaagagagctccagtcaaaaagaaatgagagatctgggcacagagaaagtgctaactagtaaaacacaaagaaaatgaaggcgtgagtcgtagctgaatttgagagctcttcctacctccaagtacacaaaggcttctttcctgggctgagttgggtgtcagaggagagtgggtatttgggattcagggagcagggccctttcttcaaccctgtaagaacaaccttgctcctcccacagcctggcctaattcttggtcagagttgagggagacccatggtttggaggtaacttctgaccccaacctgatcctgtgattgcttgcaggccatttactgccttgtgacgttggtcttcttttactcatctgcctcattttgggcctgggtaagtatctccatcctgggaggtggatgagtgcgtagggtcagtggctggcctttgataccctcattcttgctctgcagttggccctgggctttagtctggcagtgtatggggccagctaccactctatgagctcgatggcacgagcagcgttctctgaggatggggccctgatggatggtggcatggacctcaacatggagcagggcatggcagagtgagtgtcccccaccgccagcccaggtgagcggccccagggctggggcccagatagcccaagaagcacagctacttgtaacttgaaaagggtggaagggagttgcaacttgaaaagggtggaagggcccatatgctgtctttccagctttatttctatccacaggcaccttaaggatgtgatcctactgacagccatcgtgcaggtgctcagctgcttctctctctatgtctggtccttctggcttctggtatgtgggctgggggcgctcccaagaaggggcatctaaccctccccatcttttattccctgcatcttgcttcaagttaccgtttctcttgtaggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtggctgatggctgtgtgggtgatgagggatgaggcaggaaaagctggtcctatgggatttccctcctgctacaaacccagcctggtggggaccctgaaagaagagaaacctgttggattagctaagaaaattttattttgctccgtgcgttcaaggagctcacacacatgcacatgcatatgcatgcacacacacacatacacacacactcacatgcatacacacacggctaatactgctcaaggcatggctcctgggcacagagttctggggccagaattctgctctgggccctcctcactctgtcatctcctgcactgcagtccagggtccagatagatttccgggatacagcaccttcacacctccaggccaggacccttgcttagtcccagtgcctgcaccaggtcatctccgagcccactcttcaacgtccttctcactgcagggacagagcagggttggagggggttgatggggttcaggtgggcagtgggattgtggggggttacttacaagacttgcggttgccgcgggaacgcttgcgttccctagcagctaaggcacgaggactgctcttggtcactgactgcaccagaaggtccatgatctcatctgatgtatcactgggtaaactggagcctgggggttcttctggggatgcagtggagggccccactgtgggcatgattggggagctgctctggaccatgcctgaggaaggccagatagcaaagtcaggccaaggtggcactggagcccattccccacagctgctatgggcctcacctctgctgcggcgattgtgtgtggtgtcctcaggcctgctggtcagcagactcttcatactagcatgactgtcagcatctccccggcctggcccgctgctcactgctactgggacagaggggttgctgggggcttccccagccacacctgagaacttctctgtctggagaaagaagaagggtgagctgggaggagcgaaggaaaccaaggaggtggcagtcaagactaagacctggaagggcacccacctcggtgatcatgcgtccccgggtcttgttgcgctcacggtatgtggcctgcttctgctgctgctgtagcactcgttcccggcaagtccgatactcaagcgcaaattcccgcagcgtgtggcagaactgcatgatgcgcacttcacgggccgcctgcggggtgtagcccaggtagagcaggaaggcatggaacctaggcaggtcagagtagggagggacagtaagtcctgcttattgtctgagggagggtggtggccgtcctgcctctcttgggtccatgcccctacctattgcagacacggcggtgcactatccttagcatggcaacacggcgggcacactggtccaggaagtgggtgaggcgggcacgcagggctggggccagctcatgcttggccaagctccgcaggctctcctcggctgcccggctccggcgctccagctgccccaggttctcagtcagctgttcaaagtccacctgagaaagcaagggggtgcacatactgtccccccacaccctgtagacaagacatggcccgaggctgcttctgggccagagtggccagcttgggccctaaggacacagacatccaaatctcatagactagtgcaagagacacaagtccatctgatgtgaatggggagcagaaggtttactgggggaagtggcagttaaacagacccaaagactgagtaggtgtggccaggccaatagaggaaagagcatttctggcagagggcatagctcacacccaggtggctggagcaagccctggcacagcagcccaaatggggagaagggggaggagccaggcccaggaagcagcgctcctcatgccttgtccggccttggttgattctggcaggtgctaaccttggcacagcgggtcagggcagggatttctgaatagaggtcagaggactcaggccgggtctggagcactagggagcagagatggtgtagcagtgactgtcgacgcaccgtgtccttcacctctgacaccttctccaggtagctcagctcaaagccgctgctctgaaaggaccctttctgagcctgggcctggttggctccagaaccctgactccccctagtccccatgtactctcactcacctgggagccattgaggaagttgcccaccgctaggagggtagccaggatgcagcggaaggtggcattctgtaccagctgttccatacccactttcaggtcaaacagtggctcagcaatttcctggtatgggagaccagggactctcagactacatggtcatgatgcttacctgtccctactgactgtcccactccaagacccaggtacccgctccatgctgtcatagtccagcttgaaggcccagagttgtagacgagcagcgaggccgccaatggaggcaagagtcatcaggaagttctcggctgggcccaggggtatgtcagggttggccagctgggcttcctcaatcttctgccgctcttcctccgtgggcatcatggtcagtagcttctgaggatgtagccagagcctgacatggccccctcaatgcaggcctgaggcctgaggcattggtcttgacccctcagtcatctaggggaggccccagtgtctggggactgccctgcagaaatgccaagcccatgcccaccaccagagggacaggaaatgcccacctaccaaaggagaaggccagacctccccccaacacccatagctgggtgacctcacctcaatgccatccttgctgacagcaaactcatcaaagttgagcagagcagccttaatgacatgcacaggtggcagtgtggttaggccgatgttgatggcgttgctgcgcttggggtccagcactgtggtcattgtccggcggccctctccagctttctgcatggttgggggaagggcagtgtaagactgaggaagggggcctgacgcggtggctcacgcctgtaatcccagcactttgggaggccaaggcgggtggaccacgaggtcaggagatcgagaccatcctggctaacatggtgaaaccccatctctactaaaaatacaaaaaaaattagctgggcgtggtggcgggcacctgtagtcccagctactcgggaggctgaggcaggagaatggcgtgaacccgggaggcggagcttgcagtgagctgagatcacaccattgcactacatcctgggtgactgagcaagactctgtctcaaaaaaaaaaaaaaaaaaaaaaagactgaggaagggactagctgggacagcaacctcagagggcactccaaggccctcctctagattgccaaatgatcccacaactgacaaactggcaacctggaatgtgtaagtcatggggatgagcttagattcttttgagacagggcctggctctaccatctaggctggagtgcagtggtgccatcatcgcccactgcagcttatcttctgggattttcctgcctcagcctcccaagtagctgggattacaggcgtgtaccaccatacccaactatttttttttttaacatttttttttccgcctcccaggttcaagcaattcttttgcctcagcctcccaagtagctggtattgcaggcatgagccaccacgcccagctcattttcatatttttagtagagacggggtttcaccatgttggccaggctggtctcaaactcctggcctcaagtaatctgcctgccttggcctcccaaagtgctgggattacaggggtgagccaccatgcccggctaattttttttttaacatttatttatttttatttatttagttatttttgagacgaagtcttgctcttgtcccccaggctggagtgcaatggtgcgatctcgactcactgcaacctctacctcccgggttcaagtgattctcctgcctcagcctcccgagtagctgggattacaggtgcccgccaccacgcttggctaattttgtgtttttagtagagacggggttttgctaatttgaccaggctggtctcgaactcctgacctcaaatgatccacctgcctcggcctcccaaggtcctgggattacaggcatgagccactacacccagaccaacttttagtagagataatgtctcactatgttgcacaggctggtctcaaactcttggattacaggtgtgagccaccatgcccggccacatttagattctagttggggcactgctgatcccttgttaggagaccttggacaatttcctactcctttctttgccttggtttccccatgtgggaagtgagtgactagctccaacaggtcagatccttaagctctgattccctcctgcctcccttggggctaccttgcagatgagtggatttaccttggagggcagcacctctttggcacgagactcaaagaggtgttccagtcgggccgtgtccactgagacagggtccagtgaagcccagagggtggcgcagggcccaaagcggcttgcagagactccatggcccccagccagcttcagctcacgccagaaaagttttactgtcttcctcttagtggggagggctgagctgtcaggcactgaatggggaagaggggcagccagaggtagaggtggaggtggtgggaaggggcctttgatgggtgggggaggtggaagtgggggaggggggggtactcccgagagcaggggcagtgggggtgagggagctgggatgtctttcccagcctccacagactctacattcagcatgtcctggtcttcatcctcccctagatctgaaaagtccaggtccccaatagagagcctgggtgcacgggtagggagctcccagatgggctcagccttggggcttgctggtatcagtggctccttgggctctggtgcaaggcttcgctgggcccggagcaggacacagggggcagggctctggggtgttctggctgcaggggctgtctctggggagtcccagagttgccgggcatctaaagaaagggaaggagctgtcagtgccatgccccctgtggggcaacaaagcaacaggcaggctctgcctgctcacccacctactcacctgggtgtccacccgcctcattgggcatggccccggcaagtgtctctgcccggccctgggccagcgcaacctgcttctctgtttctgctgccgccacattctccaggaaccgggctctgagggaaggtgcttgtcactgacagcgtctgacacaccccagcccaggtgtacatgccttgctgagcccctggacaccacccccaattgcaggcacgcacagacacacagggaacagtccatgcgctgagcagaccagaaccacaccccccccaaggccagcccctcttcagtcctccacatctggggaggattactaccaacccagcattcccaggtgaaaacacagggagaggatctacttaacatctaacttgcaacctcgttcatgttcactgtcctggtttttttttggttggttttttttttagagacagggtctcactctgtcagtcacccaggctggagtacagtggtgtgatcatagctcactgcagcctcactctcctgggcttgaccctcagcctcccaagtagctgggactacagacatgtgccaccacgtccagctgattttttaatttttttgaggagacagggtctcactgtgttgttcaggctggccttgaattcctggcctcaagcagtcctcccacctcagcctcctgaagtgctgagattacaggtgtgaatgatgcacccagccaaattttaaaaaatttctttgtagagatgaggtcttactgtgttgcccaggctggtgtcttgagtctagacaaggactcttagagcaggggaaggggatagctgtcccaatgggcatatcaggctgtccctcccttggcatgtctggtagcttctgggagcctatgcccaggaaagggcctggtaaacaggccaggtgcggtggctcacgcttgtaatcccagcactttgggaggcagaggtgggtggattacttgaagtcaggagttcgagaccagcctggccaacatggtgaaaccctgtctctactaaaaatacaaaaattacccaggtatcctggtgcaggcctataatcccagctacttgggaggctgaggcaggagaattgcttgaacctgggaggcagaggttgcagtgtgctgagatcacaccactgcactccagccttggagaccgagcaagactctgtctcaaaaaaaaaaaaaacaaaaaaaaaacggatgtggtaaacagtggaccctcagtttatgctgaaataatgggtgcaatccagtgtttcttttctggcccctccagcctctgtcagctctcagtccctgcctttccctcagccttaggttacccctccacccccacaccacacaccacacagcaccctaggtcccctccctgctcgcttctgagctgaagacttggcagaatgagccccaggttgggtgtccacatccccatctctggctgctaaggtgttgctattgaagcacagggaccactgtgaccccagtgaattggttcccagtgcttagcctttgggttaccgaggaggcatatgtctgggagaggataggcctgagtcccccagctttggttgcatcaggcacgtgaaacccctgctgggggaagcaatgctgaagccctgagcacatggcaggcctggcaggccggcctctgtacttactccagcctggcctgcccaggaggggactgggggacgggtgggctctcaggggccctgggtaggggggatgagaggaagagatggtaactgtggtgtcagctccatggttgctcatacccacacagagctaggcagtgatattggggttccttcccagccgcagtgggaagtgggggaaggtatgacacgaggaaactggaagtggaggggagagactgacgtggagcaggacagggtgctggaagagacagaggcagcagaacaagggagtgacagatagtgggcgggagacatgacaagaggcaaagacaggcagaacgtcggaggagacaaaggaaaccacaggaggaggagatccagtcagagccgaaccccacccgctggcagtcacttaccaaacggaagcagtttggtgaagtctggaaagagagagagagaaagcacgcgtttgggcagaggaggctgagtgcccatggaggggcgcaaagcggagggacaatgggagagaggactccagggtggcctctgtctccctacttacttgtagatgctcctctcgctggaggtgtcagctgagggtgccacagagatggtaggaaaaaggttcactgaagcttggagaccggagggagggcccacagggctggaggcggggcctgtcagcagggcggggccggtggaagaggtggggcctaccggtgaggcggggcctgtggggctgaaagcaggggctgtcagtggggcggggcctgagaagctggaggcggggcctgtcagtggggtggggcctgcggggcgggaggtggggcatgtcggtagggcaggcccagtggaggaggtgggggctgtctgtggggcggggcctgagggggttggggtcagggcctgtcagctcactgggccatgcctagtagatccaccctttcccatctacagatgctcgtacttacccaggttccggggcacgcgcggggcagcccccgccttccagagaacggcggctcctcttgccctcctcagaagaaggctttcgtcgttcccgccgcccaccagcgcctggggcttcttcgatgtctccatcctccaatttcagggcgttctagcagaggcggaccaggatgtaagaaagtggttaacgtgtatgcaggtggggtggggcgctggggactgcgcttctctcttccctctttccaatccgcctcagagcgtaaggcccggcccacctcgtagagcacaagctgcgtgcgcaggtcgacgtcagtgcccgcagtgcccaggtggcgctggaccagcgcttccatgccctgctgctccagtgcatccgtcacatcgtagaaggagtcctggtccgggagcgccgccagcgtctggagggcggggataagaaggcaaggctgaggttggtggggaggtcaggagcctgagcatcccagagctggcacccagtccttggccacaccttgttgatgagggtgaccgtgtacaccaacaactcagggtcagcgccattcttctcctccaggatggacaccagattggcccagggaggagcacctgccacacagaaagtggagcagtcatgggggaacaggtaggagagagggctctgagcggtggggggagaaagggacagtctctgaccggtggtgctggccacagagttcactgcacggatgaacagcggtgcgttgttttcggagtattctacaaacaccaacagcagcttcagggctgtcttcaccaccaagcgggactgaggagagaggtcagtacatatgagtggggcttaggccagacctgtgccagctgttgctggggaaggggaagggctgctggggctggacccagagagaatctaggcagaatgaccctggccccaggcccaggcactgaagtgccttataggcttacagaggcctcagactcactcccttccagctcactttgcagaacaggaaactgaggcccagagagaagcaacaggcaaagggtataaggctgagtggagagccacttaccaggctggcacacaatgtgtacagccactgaatagtgtcactgtgggccaccacccccagcattccatccacaaagagcatcagctggccgagcgctggggaaacagggatgggcagagtcagcgagggtcgctggagcagaggtcatgggagaggggcggggctgacctctaaggatgtagctctggtagttgtggtcggcagcagcacccacacggatcaggcagctcagcccctctgaatgcacaaattcaggcaccaggtctttgtcctcctagaggcaccatgggggagtttagggaagcttgggctacacacttacccccagcccactgcggggcctcacctggaagatctgcttcagtgagaagagggagcggcggagctcaggaccactggagctatacagcttttctgcaaaaggtagggtataaaacccttgatggacacagactcactgtcttcctctgcttggatacaaccacaactctccaccaaagaatagtctaatatatatgttttggtctgagagacagggtctcactctgtcactcaggctggagtgtggagtgcagtggcacagtcatagctcactgcaacctcaaactcctagcctcaagcaattctcccaccttgacctctcaaagcactggcattggaggcatgagctaccacgcctggtctattctaacattcttgaatccccctccactcccaccatggccctggaagaagaggtcaggatagggagaggaaggagcacatacagctaaacctactttgctcactgttcagcacaggcctgaaggtgagccaactgggctatggggaggaggtgctgctggacatggatgctctcacacactcacccaagatagcgttgaccctcacagagagctgggtccgaaggatcagcgtgggcttccgccctttgctggaatcaaggatctctgttagcagctcccagcctatccctcagcattcctccccacaagccaagggagccaaagacctccccatgccagccccagcccagcttgttcctcccagctgctcctccaagaacccaagggttggtcggacaagagggttggtgcaaacacatgtatctcaggtatgtgggagagcccctaactcccaccttgggcagcaggtaacactggccaggctttagaattcccctggcacacttccctggggcaggaggtgacccatggctcaggctagtgatcgagtgtctcagctgctgacatttgagctagcccctggcaagggtgggggtaaccttgcctccctggccccatcagttctgacctgatctcttcatagaagccctccagcatctcccgctgctcttccagggacagctcggtgtccaggtagtatccggagggagacacttgcagagcacaatcctccaactgggggcaaagggaacagctgtgagactgaggaagaggtggcaggcgaatgtatgaagacccctgacctcttacctaccacttgaagggtggcagagagacacagggtctgcactacagctgtgcattccttcagcagttgcttctcaagcacctactatgtgcaaagcccatctgtgtcaggcaccaggctttcttggcctttgtttgtaccatctcctctcctggctgatacctacctattctttaggttgctatgcaacccactccaccctgtgtgtatgctccctttcgagaccttccacacagcattctaatatccgagccactggtctcctctagctgcgttctctgcgttcaggcactccgtctgtcttgctccctgctgtatctatagagcctggcatagcacctgacacacagtaagcactcactaggacttgttgagctaataaacacagatgaggaaggggaatggagagaagatgggaggaagttcctgccttcgaggaagctcacagccctgtggggtgataagctatagtcacaaagcattaagccccagaaagaaagtgttaagatggctgggaggtgcaaacccacccgggagagtgtgtctgtgtgtgtgtgtgtctcagtgagtaagagggtgaagacagggtctgatccatagacttcccagtcccaccagatttcagggtctttggcctctcccaaagtgggctacagttacaatggtcctagctggacctcagagacacccaaggggcctattaaaaaactaactttaggccaggcgtggtggctcacgcctgtaatctcagcactttgggaggctgaggagggtggatcgcctaaggtcaggagttctagaccagcctggccaacgtggtgaaaccccgtctctacaaaaatgcaaaaattagccaggcatgatggcgggtgcctgtaatcccagctactgctggggaggctgaggcaggagaattgcttgaatccaggaggcagacattgcagtgagccgagatcatgtcattgcactctagcctgggagacagagtgagactctgtctcaaaaaacaaaacaaaacaaaacacttaagagtctgactcagtctacagtaggaccccaaagcctgcctttgtaacaagcaggcacatgctccatccacgtgtccatgtttccctccccgggctctcctcccccgccacaaggcatggcacttagccccttgagaagtgcctgtagagaagcctgagggaggtgactcctgtgagtcggagggtggcactctacctctcccagacacctccctccattgcacagtgcagatatgcaggttcagcaaagtctccttgacttaagtggctctggcccttgagatgccttggcccagggagagcccacctctggagaggcagggtgtcttctggtctccatcttactgggcatgtcaattccaacatttgtcctgctgtttggtcagccctgccctcttctggaccctgcccaagggcttccaactggccttggtcccctggagaaaaagggagtccagctcctgcctcaacccctacctctgtttagcaacccttgcgcctgcctcagagcctgacctggctccttccccacagtttagcctgtggggcccttggatgacccccccccccgcccacccccgcctgggacctgggacataggacaaacactccagcctgttctctgtcccacttcctgcctggctgcctgccctccccagggtgccttgggcaggcctggccactttcccctccctgggagcagagtcatcttctccagggcctactgggaacaggcctgagaaggggcagcaaggcctgagggctggggtatcttgtccagggccagctcagctgagggcaacccacattcctcctgatctcttcccacacagtgactcagcagcctaccaccccacccccattcaggcacagccgcatctccctcccttggcctggaagattctgggaccctagaagaacacacctaccccagagccacccccgtcagggatcccctcgaatcacacacatatagaacagctcattctttgaacattcatgaccaggctggtttcagatgcagaggacctaggaggaattagacactgcctctgccttcccttccttccagcccagtggggcagacgggaagacagacagacgagtcagaaaaagctcacaaatgaatgtggaatcacaactttcacagtgctaagaaaggggaggggcagagtgctataaagataaacgggaagggaaaacatgttacacctggtaactgcttacacacccaggtataaggttgggtatgcactggccaacacaggctgaagcagcacagacccagaaaggtcaggcccaccacgctgtcctgcctccttgcatgctgtaatcccaagagagcagagaatgtccctctccttccaggacacctgcatccatttggggaagggtcctgaaggttaaatagtccaccttctttttttttttgatatggagtcttgctctgtctcccaagttggagtgtagtggcacagtcttggctcactgcaacctctgcctcctgggttcaagcaattctcctacctcagcctcctgagtagctaaggttacaggcgtgcatcaccatgcctggctaatttttgtatttttagtagagacagggtttcagcatgtcatccaggctggtcttgaactcctgacctcaagtgatccacttgcctctgcctctcaaagtgctgggattgtaggtgtgagccactgtgcccggccaatggtccacattctctagcctcctcagccacttcacctgtccaatcctgccagggccccatttctggggaggaggtccagggaaacaggtagtccagtgccttccaggacagtgtctccccacccccagctgtctgtcctgggtggaagtgtggggtggtaggctagagtcaggcaagcagcaaagagcaggagacttcctgctagcaggatggcacatgtccctcacaccccggccccttcctggggtcacccttctgagagccaaacctctgggccttgtttctcacaccctggggctgggccaggcctgaataagcccaaaccctggtccttgctgacggggcttaagctcagcacgtagtatgggcccacttccctgacaccttcttggctcttgtcttcctcacttctctggtctctgtcttggggtggagtctttcccccattcttcccaggctcagcttctcacattggcctccagcccactatactcttgactttccaggctcaggcttttctggcagcccaaaaccaactggttatgtatggttttatatgcagggtcaagcccaggggaccatggcatctacttctctctctctttctagctatctatctacctatgtataatatatagatatagatctataatatatagatgtctatagatattgataatttatatatatagctatgtatctattatatatatctagacatctattacatatatctattatatattttataaatatacatttttcccgcttgtttctttagactgtcttacccaatatttttaataacagtgtaatcaggtaagactgaacataccagagcagggtacagggaagatggaaaagaggcaggattataggctgaagggctttcattttagaaaataattggttaactgcctcttttgtctcctttcctataaacacaggaccctgtgttctgaagaccctcctttcctgttatcgcaggtctccaactagagtgtgacttcctgaatgagatgacaaggatgggccttggggagggaaatccacttttgttatcttatgcttcctctgtgccaggcaccggactgcctcttttttttcttttctttttttttttaatagaaatagggtctcgctatatcacccacactgttcttgaactcctggcctcaagcaatcctctggccttggcttcccaaagtgctgagattacaggcatgagccaccatgcccagcctgagccgcctatttaatttgattctaccaataatccttttacagatagggaaaccaagaatcagaaaatcagcgcattgccccagggtgcacagccaggagccagggctaattgaccaaatcttgggcggatgggccctggaaatgctccaaggaaccctagaggggaagtggagtgagggctggggccagaaggattgccaagagctgaagacatcctcttagttttctggactctgcaaataccccatactggtcctcccagttccagtaagggaacaccaatagacacacgcaccccatgcaagttaggataatagtatctacctctgccaggacctaggtgtcagggtccctcaccagtctgcagctcagccactctgttccagaatgaccagcagattggatagtccagccccaggggaggctaggaggagaccaggactcatgcccacacctcagttttctacagtctcccaaaggctcctgagatgtaaaaaggctagagtgggttggggtagggtcaggaaacattccaggacagtgccacccctgtcctactctgatttttagccacagctagggaaacaaagttgctagtaatgaccagatttctagggctatccccactgtcaggaggagagggctttcctggcctttgcagcagggtcagagaagcaccccagatccccctacccggagctcagggagaagtcagtgctataccaggtgtggtagggccttgggtatcggagaggctcctgagacacttcccagaagggagggtagaactgggaggctctagattaggagatgagatgcaaggccagagggacacattctcccctctggcaaaggcaggtctgggctgggggaatattttggaggggaggaaggcactcctgagttcccccagggacactaggcccggcccaagacactgtcaagctcccttccaccaaccagggccaggagatgagtcagaggctgtggccaggagcttcctcctagtctaggaggaaatgagcaaggctttctgagatctgaaagctctttaaaaaggaagcccccaggggaactctaggggctaggctcggcccaatggggtgtgtgggtggagtcccagggagaaagcaggctggcctctgtacatccccagggaggggggtcatctgctgggatgatcagggccagtacccggggccagtacccagaggaggacagaggccacttggctgtgtcctgtcctctgctggacaactgtacataggacgaagcaatgagtaaagaaccccttcctcttatttctgccctacagcttgggacagggatgccctggtttctgggccacctcttccctctagagggccagcaagacaggcctgagtcatgtctgtgactctggggcacccacttataggactacgggaggaaccagctgttgacatttcctgcaaggaggggccctgctcccccttgctcagctctctgatgtccctgtctctgccctattctcagcccctcttcctccagccttctattctggggctgtggtcatagtttatatttgggttgagcacatcacagtgcatctgaccattcctggcagagttgctagccccagggaatcctggcttctggcattgtggtaacctagtgtgccacctccatatccctgtgggggagggaaggcagtcctcaggtactccaggtgggagaacatgaaatcggggagaccaggaaggactgcattggggatgaggaacttatattcttcaccggagctcagtagtgtcctcagctaaggagcagggaacacagggcagagcacctggtagggttgggtggggacacgggtcccatgagagggagatagaaggagtggttctgagcctctttcttgcagctgacttcccaggcttgcccccagctgggaagaggtgtgtcaaggggctgggcatggtggctcaagccttaatcccagcactttgggaggcttaggcaggcagatcacctgaggtcaggagtttgagaccaggctggccaacacggagaaaccctgtccctactaaaaatacaaaaattacctgagtatggtggcgcacacctgtaatcccagctatttggaaggctgaggcacgagaattgctagaacccgggaggtggaggttgcagtgagccaagatagccccactgtactccagcctgggagacagagccagaatccgtcttaaaaaaaaaaaaatcgggggggtggtgtcagggctaggtccaatccttgagttgcaggatgagaggaatacaatatattctctagtgccccacccttatttcaggatccggactttaggagcctggaagcgggaaccagtcttagttcagcactcctgtcttcccagcccccatcctgaatgggaggtggcctccagctgcacacgcttcttccaggcacacctcaatttgcccctctgaatagggcaagagaagcgggggctgagtcaaaactggcggtgagcagtgtcctgcatccttccagccatggccttgaagccggggttctggcctggacacgtgccactctccaggccaatagtctcaccacccctcccgccagcgctcagaggcggggctggccgcagcgcgaggaatgcgggctgggggcccggggcacattccagggaagaccccaggcccaaggggcaagtttacgcaactcgccgcccagctgaggctgggagcaggggagggcacccaccccgactctctctcctcttctccagcactggaggcggccgggctggtggggagcttgtggaggtggtagtgcgcctcccagagtcctggcccggaaacagcgcgccggaaagggctgcctgcggggggctgacggcggcgagagggaggggagaggaggtaggctggccatctggaaaagggcctctttccgcactgtgcacaagtccgcttcggggcggcagcaaagtagggcaggccggctgtttaaaattagtccggccctccctctcactttcaggcgcgggccgatgggcggcgagtgtccgggggtgggggcgggagcggtgactcaaagggcttttacacccgtgcagcctcctgcgctctgcggatcccgggccagaccgcttcgcggggactcccctcaccccgtgaagtctctcctcggccggcactcccatactcccattgacctacagggtcaagccccaatccagcttcctgacaccgcaggaaacctctgccacctctagtagtccgcctcgggcccgcccctcctcgtggtcccgcccccacctcacctgaagcaggtggaagctggtccctccccagctccgcctccagggtccgctacagcccaagcggctaccgtcactctgaccagggaagccaccctggcagaccgacggcgagtggaactcgagcacctccccaggtgcgcctaattcgaagggcagtcagaatggcggagccaagttcctggcacccctcttcagtttcccctcaacttgagaggggactcccccgcaggcggggcagagtggaccctgggaccccagcccaagacttttccggagaagaacactcgctccagcctcttcccgcggagcacctcccaccagttttcatggcgcccaccctgaacccccgatcgccccaacctttctccggcctccctcaccttgagcggcgctcccagcaggcggtgcaccgcgggtatctgcgcgcccaagggcagcgccccgtccaggctgcaggtgggggcccggcgcggctccggaaagttggcacatgcgaaggggtcggtgtcttccaggtactgcaccctcacggtcaccactgataccggctctccgtccccgcggtcttccccgcccgccatggctctgcggccggctcacgcagcgcgcctccgagtcccggccccagtgcagcttctactcaaagcacactgtagctccgcggttcgggcccggccggaccggacgcggctggaggggcggggccagacggaggcggggccgaggaagggggtggagccaagattagtccccgagtgcgcgccaggaggtaaccactgccggaggcggggccgccgctagccactcacagggcccaatgggaatcccgttagttcactggctaggagggcgggaaaaaccgagctcgcgccccaccttcgagaacgcgcagaaggcggggaggctttctttggtctggggatagtgaggctgcgttctctttgaggggtgttagggcagatggggcagaagtttctttagatagtggccggccaggtctctctcagttgagggacaagatagccctcattccttccatttgaggggtgagtccctgtggtttcctcatttagggaaagcagtgagagggggtcccttcaatttggagcaagaagtgagaataaattccacccagtttgaaggaagaggtgggatcagttccctttagttgtgggaggaagagggaaggatgcccttcagttttctgggaaaagattgggaggagtcagtttgagggggcagatagaacacgttcccctcagttttggagaaaaagtgggatgggtgcccctcagcctgaatgaaaagtggagacggtcctcctctgtttggggcgctatgagccgaatgcccctcagatttggaaaaagttgggtgcatctcgcctagtttgaagggaatcagtaggctgggttttccataggttcctgtcagcttcatcaaagagatgagacagttctctgtagtgtgactgaaagggagggccaggtgccccttggtttgggagatgaagaacagcctccctcttcgcctggcacgagctgggccagtctgggccttagggtttctgggacgttgggggcagcgttgtccgtcactgctttggggagcgtccagtgcgcgtgcgcagctcaggtccgggtgggggccggcagggggtcctgggcttggcaacgtgggcggagggcggccaagcacggtcccctgcgttttgcacccggccgcgccttggtcccaggggggtgctgctcgccgcacagcagcgctggccgaggaggagccgtgcccctcccgtcctgaccgcgccccccgcagacccccgcccttcccgctgcgggctgccccaggggggccgtggccgcgcaccgctctggatctggtgggggcggttttggggaggtttgggggcgcggactcgaaggagtaggttgtggaacttgggggagagctgcactggggaatttccggagctgggactgatttagggaggaaagaggagagagtccccgactacgagagtccgaggcagggtctcggagcctggacctggcttgggggtatcggagccgggattggggggagcgggccccacgtgcctgtgacgcgggggcgcccggtaggtggcggcggcgacgcggggccggcggccgtgcggtgccgggagggcggctgggcaggcggcaggatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcggtgagtgcgtgtgtgcgtgcgccaggccgaccgccagcggcggacccgcccccaacacccccacctcctcggtcctcagattggggctggcttcttgcacggtgctgggacttaggtttggattccacaaatccgggctctcgcccagttcctgcatcgcttcttgtgggtcccaggtccctgtcttctcccctgggagctctgaggatttgcctttctgaagggctgtcccccgctctccccaactccatctgtaggctcctttgccctctccgctcccctcttccccttgcagtaggccctcttcagtctggtctctcccccaccaatccctagcctcccagaaacctctgtcgctggtgaggatgtgtggggacattgaggggagggtgttctcccaagaacacaggcatcctggttctgaaaaagcagccttccctggagaccatgtccgagtgtccattcccttgggaaactacactgccacttttcctccagctctcccctgctccccacttaaagctgctgccttcttgtgcctgtgtatgggtacccccccaacccacgttcaggtccacattcttctcacttcagggtataagaaacttccgtgtatcggggccttcctgtgtgctgtctaccctagatgctttcatacatccgacctcttcagtcctgacagcattgaaggctgtgcttcagacttctttttccctgaatagagctgcttttccttgcatctgctccttcctcctcccttctgagcagccagtggtccctcctcccaccagagaccctcctccttctccctgttgtgctggctctgctgtgggggtgactaattatagctgagcgttgctactctctccccatggatgctggcacagcctgtactccagtctcaccaatacagccttcatggaggaatcacccagagcctagaatttgcccctcttctcccacatggacactgctagggggtgagggggctgggcaggaacagaactctccactctgctgtggcagcctgagattaataatggaaagtggaactcaatatgccttccgggagcgtggttctgtgatggggcttggatctcggggctggggttaatgcatgaagagatgaagatgaaatagggtccccgaaggagagaagtgggagaccaaagtagggacaagtatggagagatctatgaccatgtttaccttagaggtccagcagcaatgagagtaagagtagaaagagcctcaggtttggagccaacgattgggtttgctaagtctgtgagttgcagaagagttcctgtcttagggtttatagcaaaaactgtagttttccccataaatcatggttctttttctagtttggatgacatttcctatggaagtaagagaagagagcctccttttcacaagtcaaagaaaatcctcgaacaagagaaaaggcagagcattcaggaacaccttcccccagcttcattgctaggagactttttcccttttattaaacaaatatttacatagagctcactatgtgccaggcactgttctaggccctttgggtacagcttccaaagggcactgtcttggcatagggtctcacagaggctaatttagaggtctccttccccaacaccccagggattatgtagagagagatgtgttcgcttgtggtctgaggacttaaaggagagccaaagagtttattttagaggacaaaagtaggagtggctatagtgctagaaacgcttttcttctcccctcctacagacagaactgttctatttaattaacatttggtgtgtgtctaacatactatgtgtctgacattatgctaggcacatttgcatactttatatcattttatcctcacccttgatgctgggtatttttcctatattacaaaagaagaaattgaagttcaagtaagttaaataatttgcctgagatcacatagaatgtgctaaggctggaagaagacctggagatcttctgattgctaaagccaaagttttaaaaactacgcagtcctgagtgagcccatataatgaaaagcacattgggctaggaagtctacacagctcctaggaggtataatatacattctggtctagttaaggagtgaggacattataataggtaacatttattgagtgcttactgtaaagtagtgtgctaagtgcttttgagtagattgtcttttttttttttttttttttttttttttgagacagagtctcactctgtcacccaggctggagtacagtggcatgatctcggctcactgcaacctctgcctcccaggttcaagtgattctcctgcctcagtctcccaagtagctgggactaccggcacccgccaccatgcccagctaatttttgtatttttagtagagacagggtttcgccgtgctggccaggctgatccagaactcctgacctcaggtgatctgcccactttggcctcccaaagtgctgggattacaggcatgagccaccgcgccccgcctgtagattgtcttttttaatggtcacaataatcttatgagatcattatcgtttttactcccatttcactgatgagaaaactgagtcagagacatgaagttatttgccctaagatcacagaactaagctttgaatccaagcaacttgactccaaagaccctgatttttacagctttcttacatataaaaagatactgggtagcattagctgaggttcaaataatggctatggataagggttgtcagagaaaggtgaggtcccctgaggatgaaagtataaaggaagggacatttctagaaggggaaaaagcagtaaaggcctaggttaccatagtgtgacaggagcactaagaaacagatgactttgactgcaggggagggtttgtagccctggagattggaaattctagaagtcttgcatatttctcctcccttggtcccagtcttagaaggttggccaggcgcggtggctcacacctgtaatcccagcactttgggaggccaaggtgggcggatcatgaggtcaggagttcaagaccagcctggccaacatagtgaaaccctgtctctactaagaatataaaaaaaattatctgggcatggtggcgcgtgtctgtagtccccgtactcaggaggctgaggcaggagaatcacttgaacccgggaggtgaaggttgcagtgagctgagattgtgctactgcactccagcttgggcaacagagtgagacttcatctcaaaaaaaaaaaaacaaaactgggagttcataggcctgtgtgtgggaggatattccataaactgatccatcctgcactctttttgcattgcagtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtaggtgagtgaccctaagacctgggctttgccagacccatcacccctctcccttctcctcaagctctggaggcccatgctggtgtgagccatgccctgaaagctccatcctaggtccctccctctggagtgcaaggcagtgctcccgctggggttcaggcctcattgaggtctctgccagtctgggcttctgcagcataacagctgagcaggagtctggctcccagctgtatgtgggctgccaaggctggggagcctgtgttaccattctgttgcctcctgccctctgttaccacattgccatttgccagcccgtctcccctgaggcatagctgtgcatcatttctgcaagggcctgctgtcctggctctccccaggccaggtctgggtggttttctgtttttattattatttttttttcttaactatatgttgtctataagaaattcattattttaaacatttatttttttaaataaataaatagatatttaaaaaataaatattataaatccatcaaatgctggcactacactgggttttctctccttacttatcccactgactcttcatagcaacccttttgtgtagtttgtcacatttacacatgaggaaatagaaccccttgcatttgtttgctatcaggtccaaggttagcagaagaggtccgtgtttgttgttgttgttgttgcttgtttttttgagatggagtctcactcttgtccaggctagagtgcaatggcatgatcttggcttactgcaacctccacctcctgggttcaagcaattctcctgtcttagcctcctgagtagctgggattacaagcacatgtcactatgcccagctaatttttgtatttttagtagagatggggtttcgccatgttggccaggctggtcttgaactgctgagctcaggtgatctgcccacctcaacctgtcaaagtgctaggattataggcatgagccaccacgcctggccccaggtctgttttactgaggctctttgcctttaggttgccctctcttgctaccttctttatttcctaacccaagaaattcattcaaccctgaaggttaatgattcacactttttccaaggtattacaagaaaacgtttacaattgctacctgggactctaacctggtttccctattgaggtagtgaactatttggggcaggaagggaagggaggacatcagatcataataacagtaatagataataatatcttttgggtgcttactatatgttaggcattggctaaggaactttttgaggtagatattgttattagtctcaatttagacatggggaaactggggctcatagaaattatatgacatattcaagtccgatctgtgttgcttttcttactatattcagttctccacacctgctgagaattgtgtcacatccctttggccgggaaccacaggtgtgggagaaagcactctcttttgttattccccctaataaaaatagttagcagccaatttccatttgctggtagttattattactgttgctacagtgctttttccctattttattttatttattattattttttgagactgagtctcactgtgtcacccaggctggagtgcagtggcacaatctcggctcactgcggcctccgcctccctggttcaagtgattctcctgcctcagcctcccaagtagctgggattacaggcctgcaccactgcgcctggctactttttgtatttttagtagagacagggtttcaccatgttggccaggctggtcttgaactcctgacctcaggtgatccagcccacctcggcctcccaaagtgctgggattacaggcatgagtcactgtacctgggctttttccctattccaaatggctgggttgagttttgaaacaatcttgtgaggcaggcagatgaggaggcatggctaaggtgagccacatgacagtgacggaccagcatcacacagttggtaagtggcaaagccagaccttaggcataggtagcttgactgaagtctcctgatctgcaggctaatgctgtctttgccatcccaagtcctctttgggcttccttgctgttatcagcaggggtggggcctgggcttgttccagggcgtgctccaggagactgggtcgtcttcaatgactggcctgtcctacacatgtcccttaatagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgagcgtgctcagctgactgccattccctgaccccaggctgcatgctctgaccaactaggggtctgcgcagactcagtcccttcccttgggtcccctggggcagaaatatgctgtctgctttcaccctgctctcccagcagtctgtctcccagcagtcccagttgctgccttcccgcctcactgctgactctcctcttctcgctcaggtgctgtacaaggtctgcaactcctttgtggagatgggctctgccaatgtgcaggccactgactacctgaagggagtcggtcagtatttccccgctcccagctggcattggaggtctgcctcccctgggttgctgaggccctcccaccccgcatcaggacagaagaggctattcgggttgcctcatctcctctatagagaaatggggtctgggaggggcttgccagggatcctggctctggggttttgagcccctgggagtgcggtgggcatcatccctcactccctgccaggcagcagtcttgtcagcccgggtagggtccgggccaggggtcatgctgacaacccactcctcccccagcctccctgtttgtggtcagtctgggcggggcagccgtgggcttagtctttgccttcctcctggccctgaccacacgcttcaccaagcgggtccgcatcatcgagccgctgctggtcttcctcctcgcctacgcagcctacctcactgctgaaatggcctcgctctccgccattcttgcgtgagttctgggggccttgcaggcagatagctgggagggggcactggagatggttgcccctcatagggacacaggcaggaacttcaggagtccataggtttccctgagcccttgtggtagtgggagcctcagactgtcctggggagtcagtaaacctcagcaatatttcaggagctgcccccagagctgtcctcagcaccctgaaaccctctgggtgtaggctgggctggaagtagactttaaggcctggggccaccagctctggaggccgcagcactccagaaggtgcattagagagcccgctagtcagagcacgttccttccaccttcccttccaggagacactgaatgggaagcctggagatctggactcttagcccagcactaccattcaagtcttcaggcctccctgggcttcagctctgagagtctgacatcctgtaatgggcaatgccccctcctgcagtatgctcaaaccctggaggctgagccccctggaacccttccccacttgccatgtctctccatcctctcccagggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggtattgctggcaccctctgctttcccactctccttcctgtcccgcccctccctgcagctcatctccctatctgagtccacatctttgtcaattcctaagcctcctcttgttgctcacctgtcccagcccctgttagacctcagcccagatacttggtcccatccggtcccacgtcctccactcccaacgctttgctcccactggcctccctcccgctgtaggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcaggtgggagtgcccacaaggctgggtagggagagggttgggcaggccctgggggagtcttggagcctgtgggacaggggcttctcttcccgctgggagatggagggccctgacttcccagaccttgagtgcagtggggtaggggtactgaagctgaagcctcattacggggagagaaaggcagcagggaactgaataggaatagggcagggctcacctcctgcctgtccatagggcttgaccatcaagccactggtcaaatggctgaaggtgaagaggagtgagcatcacaaacccaccctgaaccaggagctgcatgaacacgtgggtatcagaaccccagccctcgcctgtccctctcgaccttctcctattttgggcagagtcctgatccagtccccctacccaccccccttctagacttttgaccacattctggctgcagtggaggacgttgtggggcaccatggctaccactactggagggacaggtgagggagctgccccgaggctccttcagcagcagcagccccaccagccagggaagcatgggggatgtgccacacttctgagaagggacagagccaggttcaggctgggtgacctctgcctgaagcccttcagtggcatcccagtgctctcaggttaagacaaggctccccagtgtggcctgcttggccctgcatggtttggcaactgccagactccagcctcatcatgctctgctctgtctttgactgtctgcctgctaattccatggaccctgtcttagatcctcaggacccaccatgctcccccagcctggccactgggaccttctctgtactagaacactccttcacctccctctcacttactcagcttcgattcatccttcacaactcaccataggcttcaattccttagggaggacttccctggcctccctggctaggacgtatctgtgtcatattctctaattatcctttgtagttcttgtcatggttgcaattttacagtgatttgtaataatttcagttactgtcagcctttcccatgacattgtaaattccatgagggcagggactagccttgagattctctctggctgaggcccatatctaaaaagccaggccagtgctgacggtgtccttgccccgtctgaggaagggccacctggccaggccttgggaatgggactcagggccgggcctggcatcctctgtaggtgggagcagtttgacaagaaatacctgagtcagctgctgatgcgacgatcagcctaccgcatccgggaccagatctgggatgtgtactacaggcttaacatccgggatgccatcagctttgtggaccaggtgggccagcagcttccaggtgggccagtggtgggtgggcagatggtcagcagagcaggacagaaaggggtggcaagcaggctggccctgagcagggagttgggaattcctagctggctccatggtctggtgaagtggcagcggcaggaagcagctgggtctggtgctgacattcagagtctggcaggcagtccagagaggtgggaaacagctggactctggggtcagctcaaccattatcacttccaagcttgtgaccttgggtaagcacactctctgagcctgtttccttagctgtaagaaagcaggcataagaggctgggcacggtggctcacgcctgtaatcccagcactgtgggagcctgaggtgggtagatcacttgaggtgaggagtttgagaccagcctggccaacatggtgaaaccctgtctctactaaaaatacaaaaactagccaggcatggtggtgcatgcctgtaatcccaactactctggaggctgaggcaggagaatcgctaaaatctgggaagcgggctgggcacggtggctcacacctgtaatcccagcactttggggggccaaggcgggtggatcatgaggtcaggagttcgaaaccggcctggccaacatagtgaaaccccgtctctactaaaaatacaaaaactagccaggcgtggtggtgggcacctgtagacccagctacttgggaggctgcggcaggagaatcgcttgaaccctggtggagtttgcagtgaggttgcagtgagctgagattgtaccattgcactccagcctatgtgacagagcaagactgtgtctcaaaaaaaaaaaaaaaaaaatccgggaaccagaggttgcaatgagccgagatcgtgtcactgcactccagcttgggtgatagagtgactctgtctcaaaaaaaaaaaaaaaaaaaaaaaatagaaagcaggcatacaagtacctatgttatagattttgtgaattcgatatgtaaagtgcctagcagagtacctggcatgtcaaaagagtaaactaagtgttcgttattattattttctttattacccctgactcctgggcaaccctccatctgattgctggctgaccttggtcttgacacctgcagggaggccacgtcttgtcttccacaggtctcactctgccttctatgcccagccgcaattctgtggcagaaacttctgtcaccaacctgctgtgagtccttgagccccttccccttcctcatactcctctccattgtgccctctctctgagtcccttctgggggagatttgtcagcaccttttcatctgcccttctcctggactgcctcctgccccctctccagcacatgtgtcccctgcctcctgcaggagggagagtggcagtggagcgtgtctggatctgcaggtgattgacacagtacgcagcggccgggatcgtgaggatgctgtgatgcatcatctgctctgcggaggcctctacaagccgcgccgtagggtgagagcaggcaggcatcaggattttgagggggtggaggtggtctgaggagagcttaagaggcagttggcgccagcttgttggagagctgcagatgcccagctaaagagtgtgggtttcagccgggtgcgatggctcatgcctgtaatctcagcactttgggaggccaagacaggcggatcacttgaggtcaggagtttgagaccagcctggccaacatggtaaaaatgaaaccccatctctactaaaaatacaaaaattagctgggtgcggtggcacatgcctgtaatcccagctactcgggaggctgaagcaggaaaatcgcttgaacccgggaggcagaggttgcaatgagctgaggtctcaccactgcactccagcctgggtaacagagcaagactccatctcaaaaaaaaaaaaaaaaaaaaaaagagtgtgggttttatctcatcagtaataagaaacctctgctttgtttttattttttggagaaagggttgacctaatacaagcactgtttaaggataccttctctggtagcagagtgcagatcaaattggagggggtgagttgagaagctgggacagccagttgggaagatggagtgaaatattgtggattagggctgagcggtgggaaagaagaggggcacgtaggcctaggtgattggctctgatggtgagaggaggaggagacagagtactgggggccttgagggtcactggagaatgatggagtcacagacagaagcaagagcactgaggaagcctcctagaccagcttagcctgtggaaggtgggcatctgttttaaataatggaagttagtccaatgcagatcatgaagctttgcgtctggaaaggcccagctcatccaggagagagtctgttgcaaccccacaagagggcagcaagccattaccttgcacctttctaaaatgggaagccagctgtcaccagttctggcagtttcaacagtcaaagctctttctactgttgaaacagaattggcctcctttaacttgcacccactggtcctgatttgactcttcgcagctctgcagaatacatcttccaaaatttcaagacagttccctttcacacaggctctcttgccctcaggccagaatctcttacctcctggtatgtcttctctggacttaaaaaaacagcgcccagaatggaagttgctactctagctgtggctggccagggaagggcctagaagctctgacaccattctagttctagaacttgctatttctcttcccacagcccaagatccctccagccttggctcaccaccctggggccccacattgtccttagaatctgctaaactcccaggtcttcctcagttaatggctggcagaccctgtctcactgcatcctatggggtttttaaaaaacctttcttattcaaaattccagtagaacgaataaaataactcatatttatctatcaaccagcactgaaaaatcagtgcatgatcaattctattacattctgcagccctaccacatccctcccacactttatcttaaaacaaactccagacatcgtatcacatcatctcaaaatatttcagtatgtctctctaggtggcaagaactcttacatccagtcagtattcaataaatatcttttccccgctggatgttcaaatcagggtctaaataagtccacacttagcatttgggaaatatgtctcttcatttaaaaaaatctataatagttctttttcccctctctatctcccttgctatttatttattgaagaagctggatactttctcttggagaattgcacattttctagattttgctgactgtattccagtggtgttgtttaacatgttcctccgttccctatatttcctggttgttaaatctagaggcctgatcaaattcagggacattcaataggtatgctatatattttctgtggtgtcacatcaggaagtacataatgatttggtgaggtgtgtgtgtgtgtgtgtgtgtgtgtgtgtgtatgtggtgtttatgtataagattggtcaatgggttcagtccaatcggttcatgtgtagtctgttttttaaaaatctggaataagtttgtgtgtatcctgttaaatgtcatcttatttgctttagcccatcatcccattgtttggttcccatgtctgccaccaaatgtctccttcttagattcatatcatctgaaaatttgttaagcctgttaactttgtattcatccaaatccacataaacatgttgaacaggatagagctgaggacagagccctgtggcatgctactaaagactttcctccagactgacatggatcaagcatttttggggtatggtaactcaaccagttctgaatccacttagtatgataacacaatccacaatttctcatgttcttcatcgaaatatcattagagagagacagagatatctagttttcagttagaaagataagattatagtttaatagagagataagggctggagagaaatttggaagcaatctgtatcaggttttgtcacctggctaccacagaatcccctggggaacttcctggcttcacctggagattctgattctgtagtctggagtgggactaagaatctgtgttcttactaagttccccaggtgattcaaatgcagctggtctgatgactgatgttgggggaccacagatctgtatcactgggatagctggggcagagagaatggataagttctctgaggagagtgtttcatggggcgggaggagggctaaggataacactgaggagtgcgcatgggagaaaaggaaagagagccaaagacaaggaacccttggagaagcagtggcaggtggtgcctcaggcctggggcagaaagagggctggatgctgcgcagaggcctggccagcacctaggcagagcccacagcactggtgaccagcaagaaggcagcactgtggagttgtggaccctggagttgcatttctggtttttaaggaaatagtgggtaggagagaaagtgtcagaatcaaattataaaagtgtagcagcaaaagggagacaatggtgttcaagggaagactttctttaaggaggcaagggcaggagcttgaaaacagaggggagggagccaagtggtgaggtaaggagtgaagatacaggagagtggaggaataggaggcagcaggaactgctggaggcaggaaggagggaactgagcaatgtggaggccggggctgggcagcaatgagccttgtgaaggagatggaccccttctccccaggagagagggtacctcctggtgcataggtagatgaggagggcagatggaagacttgaagggggctcttagaactggttcagggaagcagaaaatatgagataaagggaccagacttgggatttgaggcaagataagatgatttggcaggcactgggaagcatttcaggggattaccactagatgatgaaaaggtgctaagcaaggagggtagaggcagaggcagtctaggtgagtgtgtagcgggcttggtgttgataagagttaaaaagagcatggccaggcgcagtggctcatgcctgtaatcccaggactttgggaggccaaggcaggcagatcacttgaggtcaggagttcgagactagcctggcaacatggtgaaaccctgtctctactaaaaatacaaaaattggccgggtgtgatggcaggcacctgtaatcccagctactcgggaggctgaggcaggagaattgcttgaaccccagaggcgggggttgcagtgagcagagatcgtgccattgcactccagcctgggtgacaagagcaaaactccgtctcaaaaaaaagaaaaaaaaaagcagatgatgggggtgatcctgaattattgggactgagaaggtccagggtgtcaggggagatagttatgaaagttcaaagtgcagcccaggatatcatggtggttcttgtagaaatggctagataggagattccagctggagaaaggatcctgtgtagctagaagggggcaggtaggctgggtgtgtgggcgaagctcagataaatggaggtacaaagaaaatgtcccccatgttgtcacagtagtagaacaagacagagggtcaccttcaaaccagagagaatcgggaaaggatggcaagggttggggaaggccaggtttgggggaataagttctgggataaagggaagcttttcccagggaactgagaacacagggtctctggctgggttcctgttgtattttttgttttgtttttcaatccattgttaattctggaaaagctgggctggcaggtcctgtggtgaatatgttggggctgtggcctggggttcttgtgggaggccaaggcatccatcctcatagccaggcggggctgtcattgccagtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaaggcatgtcttccctcagggactcctcttgggagctggaggctgacagcaagcagttttgagccccctagtgttaggatccagcttagggggaaccccagttgggacagtcctcaggggcttgatgactacagcagtttgggttcccttttagatgttcctggagtcccagaagggtaaggtgagaccttcagagggggagcagcctcttggccatgtggtcacctgctgggaggcagcagggccgcctaccaaagatgaaaaaggcaggagaaaaggagattcctttgaggggcaactccatgagctcctaagtcagcccacgctgatgcatccagatttcttactggggcatgggtcactcttgcctggttggccaagggatggtagaaccactgggactgacataaattccctcccctgctgggttaggaaaacttgtcctgttgaccccaccagatgacagggttggggtgggaagccggggccagaggctcaggttttctttcttggtcctcagaaggatggtgtggcgaatgctgaggctacaaatgggaaacatcgaggcctgggctttcaggacacaggcaagcagggagcagtgtgggattgaggatgggagggaggagggaaagggctggggcttgccagccagaatcctggaggacccgctgtagggtgcattcagcaccgtgacctggggctcttcctccagggacttgatttccaagttggaaatgttcaaagcagttattagacaatgcgtgacaggaggcatctgattgctaactatgggttacaggccccgaggacttggaaaatgtgtcatggagatgggggagtttggtctgggccttggaggatgggtggactctggggcccagtgtcctgtctgcaaagccaattttgttttgtttttttgagacagagtctcactctgacaagctagagtgcagtggtgccatctcggctcactgcaacctctgcctcctgggttcaagtgattcttctgcctcagcctcccaagtagctgggattacatgtgcacgccaccacacctggctaatttttttttgtatttttggtagagacagggtttcgcattgttggcctggctggtcttgaatgcctaacctcaggtgatccgcctgcctcagcttcccaaagtgttgggattacaggtgtgagccaccgcacctggctgcaaagccagttttgtatgagctgaatgttaatgggccttccagcaatccaagtgctcatgtttccagtggatcgtgggatttggggctgaaagaagaggatgggggagctggaaagtgtggtcctcatgacttcctccggggacttagcttcctctggtcgcttccttgggctccgcaatgtcagttctcttcctcccaagtccccacctcttaggccagtgcttgaaacagccagaggagaaagcaagtgtctctgccaacgtgtgttctgcctagggagacagggagctggcttggggctgtgtagtcccaacaggcagctgccagcccaggatgcctgactctgctcttgtctctgtccagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggtaatggcttcctccctgcccacctcccctctggagcaagctggtttcctctctcttcactcatggcctctactccagacaactcccttttcctattcactagtttattcatcagccagcatttgcagagcctcttcttcataccagatgcccgacataggtaatattcaaccctcacaacaaccaagatggggaaactgagcttagagagcttaagagacttgtgacttgtccagcatcacatagtagaaccagaatttgaacctgactcatctgactcccaagcccacagcctttctttttttaatttttaaatttattttattttatttgagacagagttttgctcttgtcatccaggctggagtgcagtggtgcgatctcagctcactgcaacctctggctcccgggttcaagcaattctcctgcctcagcctccctagtagctgggattacagacgtgcacccccacgcctggctaattttcatatttttagtggagatggggtttcaccatgttggccaggctggtcttgaactcctgacctcaggtgatccacccaccttggtctcccaaagtgctgggattacaggcgtgagccaccatgcccggcctattcttttctttttttttttttttttaaatgccattcttgcattgctataatcttttttttctttttcttttttttttttgagacaggatctcactctgtcacccaggctggatcatggattgcacaatggcatgatcatggctcactgcagccttgatctccagggctcaagtgatcctcccacctcagcttcccgagtagttgggactaccggtgtgcactagcacacccagctgttgtttttttttttttttttttttttgctacggggttttgctcttgttgcccaggctggagtgtaatggtgtgactcaggtcatggcaacctctgcctctcgggttcaagtgattcttctgcctccgcctcccgagtagctgggattacaggcatgcgccaccacacccagctaattttgtatttttagtagagatggggtgtctccatgttggtcaggctggtttcgaactcctgacctcaggtgatctgccctcctcggcctcccaaagtgctgggattacaggcatgagccaccgtgctcagcacccagctgatttttaaaaattgtttgtagagatgaggtttcactgtgttgcccaggctggtctcaaactcctggcagtcttccctccttggcctcccaaaatgctgggattgcaggtgtcagccaccgtgcccacccacaccctttcaaggccatgctgcctccctttgtagtctagtgaggaataggaggtggtgagcaaaccatgggctctgttgagacccatgccctcaagtagatccccaggtgaaggtggcagcctgacctggaggagcagcctgaattcatcaaaatggagttattgtggacaaaaatacagtatataagcatttttctgtatgtatagagacctaattcactcatattgttagtatcactggtggttggcaccctcaagtgtctttaaacattttttattatagaaaatttcaaaatatacaatgatagaactataaaataaactcccatctatccattatccagcttcaataattacctactcatagccaatcttatttcacctaaacctcacctatgccccaccctccactgggttcctttgatgcaagtctcaaatatcatatcactttatcaataaatacttcagtacatgtctctaaaatataaggattctttttttttctttcaagatggtctctctctgtcacccaggctggagtgcagtggtgcgatcatagctcactgcagccttgaatgccccgacttaagcagtccttttgccttagcctcccgagtagctgggactacaggcacacaccatcatgcccagccttttttttttttttttttctggtagagatgaggccttgttatgttgcccaggctagtcttaaagtcctgagctcaagtgatctttacttctcagcctcctaaagtgatgagatgaaaggcgtgaactaccatgcccagccagataaggatttttttttttttttttttgagttaggatctctctttgacacccaagcaagagtgcagtggccggatcatgactcactgcttcctcaacctcttgggctcaagccactccacccggcctcagataaggattcctgatgcatgcctctagtcaattgaccccaggaggctgaggctgcagtgagctatgatcacgccactacactccagcctgggcaacagaacaacactctgtctcttggggaagaaaaaaggattctttaaaaaatatgtaaccacaatgcctttcccatatctaaaaatctgtcatcaaacatcgttcaaatttccctgattatatatatatatatatatatatatatatatatatatatatatatatatatatttttacagtaggcttgtccaatgtcccttttaacctatagcagtgattctccagggggatggtggtggagtgattttgctcccccaggggacatttggcaatgcccagagacatttttggttgtcacaactggggaggatggccttggatggaggggtagaggccagggatgctgctaaacatcctacaatgaacaggacaaccctcaccagcaaaggagtagctgtcccaaaatgtcaagtgtcaactttgataaaccctgatccatagtttcccccaaaccccctacttttttttcttcacgatgtatttactgaagaaacctgcttatttgtcctacagtctttctctgtctggattttgttggttgcatccccaaagtgtcatttaatatgtttctctgtctcttaaatttcctttaaaccagtaaatccacaggcagtggctcacacctataattccagcacttcgggaggccaaggtgtgcagatcacctgaggtcaggagtttgagaccagtctggccaacatggtgaaaacctgtctctactaaaaatacgaaaaaaaaaaaattagctaggcatggtggtgggcacctgtaatcccagctactctggaggctgagatgggagaatagcttgaacctgagaggtggagactgcagtgagctgagatcgtgcctctacactctagcctaggtgacagagcaagactccatctcaaacaaacaaaaaaacaaaaaacctcgcctcatcaattatttggttactttgaggtacagttcacccagtaaatgcttgattctttcatttatcagttttcagaccaaagaattcattccctagcagcctgtaaaggtgaataccaaaggttttttgttttacactttttgttgttgttatcgcattttaatattccaggtctttcaagagataccattttacttttaatcatagcatcaatacatttcacacatgtactcaaacagaagcttattgggctgctcaggactttatcgatgaacagatacaggctgtactgtactttggagagctggggtggttggtggccagaggaattctctttccaggtttcctccttcagaacctcagatttcctgtaattcagccccgcccctgcagttctgggattcttagctcaggtcccctatgcctcgtcatcccctttgcggcaaagctctggcctgctgttaggtttgcatgagctcacactcctgggctttgtcccaccaaagggctgtggtgggtactcaggcaggatgctcagcagaaaaacctttggcctgtagcctccaggtctttctttccctctctggtggctggcgtttctccctcgctggttggctgggatggggcttggcaggaggctgtttcagagaccagtgctgcagtagggtgaggggactggagatggggcttcctgcctggctcctgcttttgctatcttcttattttttatttttatttattttttatatagagtctcactctttcacccaggctggagtgcagtggcgagatctcggctcattgcaacctctgcctcccgggttcaagtgattctcttgcctcagcctcccgagtacctgggattacaggcgtgtgccactgtgcttggctaatttttgtatttttagtagagacagggtttcatcatgttggccaggctggtcactaactcctgagctcaggtgatccaccaccttggcctcccaaagtgctgggattacggcatgagccataagccaactttccttattttcgtttctttgatgaaaataatgttcaatttcttgagcaactactgtgtgcccggccctgtgctaggtgttggggatagagtggagagtaaaacaagctgtggtacttcgcctcagcaagacattcatccgataatcgcaaaaatggacggcatatggaaactgtggcatgaatttataagaatgtgcttatacttgagatttccactgtattggtaatgagttcatgtgtactctctgtccccaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatggatgggtgtcttgtgtccatgtgtcagggggttcttagggtggggggcaacaggggcatctggtgaaggaggtgagaacccaactgcctgccccagggattgagaatggaggggaatcctaggcaggactattcatccttctggtcccctgtcatgcattccccaatacttttccaatattgtccccttagcaggggtcctgcagtggtggtcaaggggatcactgttttggcatcgagtcacagaactaaaagtctgcaaaatgagaaaggctagcagggaaagaccccagaggtcaggtgccaagctgtcctgatgcagccaccacacacctaggaccagatgagcatttcttgaaaacctggatgcaggtacaggacacatgaacagaggtggccttttgcacatgacagacaggaaggcaatctcaagggctcacgggatttggttaccgtgtttattttttatttttggagacaggattttgttctatcacccaggctggagtgcagtgtcacaatcatagctcactgcagcctggaacccctgggctctaggaatattctcggcacagtctcccaagtagctaggactacaggtgtgtaccaccatgcctgctaaatttttagtttttgtttttattatatttatttatttttagaaacaggatctcactctgtcacccaggctagagtacagtggcatgatctcggcttactgcaacctctgcctcttgggttcaagcaattctgcctcagtctcctgagtagctgggactagaggcacatgccaccatgcctggctaattttttgtatttttagtagagacagagtttcaccacgttggccaggctggtctcgaactcctgacctcaagtgatctgcctgcctcagcctcccgaagtgctgggattacaggtgtaagccactgtgcctggcatatatatatataattatatataatatatataataatatatattatatattatatattaatataatatataatatatataatatatattatatataataaatatataatatataatatatattatatataataaatatataatattatataattatatattatataatatatattatatatattatataatatatatatttttttttcctggaggtagggcctcacaatgttgctcaggctgttcttgaactcctgacctcaaataatcctcctgctttgacctcctcaagtgttggaattacaggtgtgagccacctcacctggccatctctgagtgtttatgatgcaaatcagatagtgtggggtccagaaacatgaatagaaatccctagatggccgggcacagtggctcatgcctgtaatcccagcattttgggaggccaaggtgagtggatcacctgaggttgggagttcgagaccagcctgaccaacatggagaaacccagtctctactaaaaatacaaaattagctgggtgtggtgacacacgcctgtaatcccagctactcaggaaggctgaggtgggagaatcacctgaactcaggagaatagcttgaacccagaaggcagcggttgcagtgagccgagattgcaccattgcactccagcctgggcaacaagagcaaaactccatctcaaaaaaaagaaaaaaaaagaaaaaaaagaaatccctagataagagcagtcccaaatccaattcccctggtgtctaaaggacttaaaacaaaaacaaaaactttggcccagcacagtggctcacgcctgtaatcccagcactgtgggaggccgaggcaggtggatcacctaaggtcaagagttcaagaccagcctggccaacatggtgaaaccccatctctactaaaaataacaaaaattagccaggcatggtggcgctcacctgtaatcccacctactcgggaggctgaggcaggagaatggctggaacccgggaggcagaggttgcagtgagctgagatcgtgccactgtactccagcctggggggcagagagagactccatcttaaaaaaaaaaaatctttgagagctgggcacagtggctcatacctataatcccagcactttgggaggccaaggcaggcggttcgcttaaggccaggagttcaagactagcccgggcagcatagcaagaccctgtctctaccaaaaatccaaaaaattagctgggcgtgatgactcgcaactttagtcccagctacccaggaggctgaggcacaagaatagcttcaacccgggaggcggaggtttcagtgagccaagatcgcaccactgcactctagtctgggtgacagagcaagactccatctcaaaacacacacacacacacacacacacacacacacacacacacaccaaaaaaaccccatatatatatatatacacacacacacatacacacacatatatacacacgcatatatatacgcatatatatacacacacatgtatatacacatatacacacatatatacacatatacacacacatatacacatatatacacacacatatatacacatatatacacacacatacacacacatatacatatatacacacatatatacatatatacacacatatatatacatatatacacatatatatacacatatatatatatatatacacacacatatactgcactgcactgactagagtgcagtggtgcgatctcggctcactgcaacctctgcctcccgggttccagccattctcctgcctcagcctcccgagtaggtgggattacaggtgagcgccaccatgcctggctaatttttgttatttttagtagagatggggtttcaccatgttggccaggctggtcttgaactcttgaccttaggtgatccacctgcctcggcctcccacagtgctgggattacaggcgtgagccactgtgctgggccaaagtttttgtttttgttttaagtcctttagacaccaggggaattggatttgggactgctcttatctagggatttctttttttttttttttcttttttttgagatggagtttcgctcttgttgcccaggctggagtgcaatggtgcaatctcggctcactgcaaccgctgccttctgggttcaagctattctcctgattctcccacctcagccttcctgagtagctgagatatatttgagatataagtcacataccataaaaattcacccattttaagtgtacagttcagtgttttgaatatacccatagggttgtgcagcccttaccacaatctaagtttagaacattttcatcatcccccaaaaaaccctgtactcattagcagtcagtcctcatccctggccctcctcagccctaggtaataactaacctactttctggctgtctggatctgaaggacttttgacacacttggaaggttatacttttagccaacttacctttactttttctgcattatgcgcagggaaggtgtgatgagaaggaagagtgacttgggctttgcccttaggttgtttacaggccacagtgataaggcctcgtagttaactagtcgtcaacagtttatttttttaatttttattttttactctttttgagacagtctcagtcaggtcactcaggctggagtgcaatggtatgatcttggctcataacctctgcctcccaggttcaagcaattctcctgcttcagcctcccaagtagttggaattacaggtgcccaccaccatgcccggctaattttttgtatttttagtagagacagggttttgctatgttggccaggctggtctcgaacttctgacctcaggtgatccacccgcctcggcctcccaaagtgctgggattacaggcatgagccactgcgcccggccgtagtcaacagtttagagtcaacagccccagctgtcactcacaagtgtcattctgggtgtgttacatgctctctctgagcctcagtgtcctcatctctcaaatgagataatcatactcacttcataaggctgctgtcaggattaaatgacaaaatttaatgggaagaatctacccagggcctggctcaaggtaagggatcataaatgtcattatttgtcgggccgggtgcggtggctcatggttgtaatcccagcactttggtaggccaaggcgggtggatcccttgaggtcaggagtttgagatcagcctggccaacatgctgaaactccatctctactgaaaatacaaaaactagctgggcatggtggtgcatgcctgtaatcccagctactctggaggctgaggcaggagaatcacttgagcccaggagatggaggttgcagtggtgggggcagatgaacatggtgggtttgacagggaggcaggcaggtgacttggatgcaggagagcaagtgcgtcaagcgctcatccatgggtccttgccatgtgactgggcagggtggcctgagctgagagaacttggctggggtagtcttcgtgaaggagatgctgcacccaggcctcaaatgaggaaggattttgattaggggagatgggcatgggccttcaggaagaggagccagtgtgagactagactagtaatcagatttgttttccaggccagtctgggaggtagatgggaaggctgtgatgcctctaagtggccttgactgtcataccaaggagtttggagtttatttaggccaaaggcaagagaggtctggaagttctggggtatttgttgccctcagtatttggggtagtactgaagaggggtgtgcaaggtgaatgactgtgggtctgttgtcactagacccagtgaggcccagagccctcccctcctttttatttatttatttatttttgagacagagtctcgctttgtcacccaggctggagtgcagtggtgtgatcttgcctcactggaacccctgctttccaggttcatgtgattctcttgcctcagcctctcaagtagctgggattacaggcatgtgccaccacatctggctagtttttgtatttttagtagagatggggttttgccatgttggccaagctagtctggaactcccgacctcaggtgatctgcctgacttggccacccaaagtgctgggattttgtggcataagccacagtgcccggcccattttatttttgattgagtcatgttggcaagaaatgggaggctgagggagagttggggaagggccaggggagggaggcccattcccattttatgatctcagtggaaaaggctgctgtgagttgattctgctgccaggagagccacagagatgggccccatgagtcactgctcagtcctgcaagctcagcccacaaagcctgctgtggtcagccacccctggctggctccaggcccagctccccaatattccccactaggcctcagtgtgtcctcatttctatctgtacctttgccatcctgggccatgcaacctgtagctctcggcctcttctgtctcctttcaggctgagtctctgaatctgtctccatttgtgactctggtttccatgggatacatagatgtggagcctcaggagggcaggggtagtgtgatcagtgtcaggcgccccaaagcatttattctgtgccaggccctgtgctggatgctgaaagtacggaagtggataacatacagtctctgtttccatgaagcctacaatgcacattctctgtggagtggagaaaccagggcccagccctgcctctatctcagtatggctgtacctcccctgaatctgcctgctgtgcccagggtgccaggtcagctatagcctgtggcttgaggctcttctttgcctctggcattcacaggggtatgtgtgcccgccagcaggtcccccccggctcttagggctcctgggggacttggctggtgggtgctggtgggcagcagaaggggagggagggagcagaaggcagtgactcagtgggggtggccctgggacagaactggggaggaagccaaggttggatgatgcttcctgaagccaggagggtgggaagagaggtctggctgggagttagggatggagcaggacaactccaaggctcccctctggcagccagacctgctcatgaagaaggctcctcggtagctgcctgaaagtctggactctgggggctgggctgggctgggtggggagattgctgttggtcccactgtgcctgttgtaatccccaggttcatgaaagaggtgcctgccttagagccagggaagccgttgcacccggtgccccctctccccagggaccatgggcctgggcacactgtggggctcagggtcttctcctggtcgcagagctgaccttcccacaatcttcccacaaattctggggagtgtcgggccaggcccacatgccctaaagggacctcaaatcgcacagctacccacttgggtagctttcatcagttcaggattccctgactgcgggtgaaatgagggggcagggcaccaacacagcccgagtgctggcagcgggtgaacgtataacacagggagtcttccccagtcctcacggcaaccccaggagaaaaatgactttccatttttacaggtgaggagggtgaggctcaaagagcagagttcctggagcgcccccagcaggtaagtggagaagccaggcctgggctgggggctctggctccagaaccccacctcagcaccagcctcctgcaccggactttgtggagaagggggtaagggggtgccagggatggcaaaggggtagaggatctggtggactctggcaggcctgggtcagctccacccattggtctcactcccacccggatggcagccccatcccacgtgggatcatgcgacctgtctctgggtgcccgcggcgaggcagcaccccgcttccctacacagaaggccttcccctcccgtcggctcattcagccgcggaagcccctgggagaccccgccccgccccgtcccgcggtgccccccgcgcactcaccctcgctcacccacgcggccttcctggcgggagagcgcttccggcgtcctcgccaggcccggggagtgggcacggtggagctgccgaccgttggtcgctgccccaacccacgcactgcgacgccgcgggtgaggcgcgcggtctgcggggcccgggggtgcggcggggcggggctggcgggctgtccgggcccacggagaggacggcggcgggcgggggttgctgcagggcccgcaccttgtcttccgcgccggcagggctgtgccccgtcgagacctgctcgggctgtggctccgtcctccggcctccagggggcggcgcggcgctgcgcggcgccccggcggcactgccctcccttcccagcggccaggaggcggtgtcccgtgacgccgcgcggccgcgctgtagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcaggtaaggaaggctgggctagggaagtctgggaagggaatggggatgcctggagagatgagtgtcaagactttggaggtctctgaccctactcaggctgaagcccgggtccaagtaggggtctctggataggtggtccaaggcagacccaagtcatttcccttcccaagcccccagtggatccggcctccctaagcctgctgactgcctcctggcccaagacctctgttgggagctgctggccagtggtatggccaccttgccaggtagccaggcgggcctagaggcggtggaggtggagtggcccaatacggcaggagttcactgcttcctccccacagggactcgggatgtccaaggccgggcagtgctgcttctgtgtgcccacagcccagcctggcttcagtctgagtgcagcagccaggaactcatccgcctcctgctgtacctgcgaagcatccccaggtttgagggagggggttgggagactgagcctgagccagctgtgaggactgggagtcaggtactgaactgaagctcacccctttaggcccgaagtacaggcactgggactgacagtgctagttgatgcccgaatttgtgctccaagttcttccctcttctctgggctcagccaactacaagtgagtacaggattgtagctcccctcattccttttcttttctttttttttttttttgagacggagtcttgcctttgtcgcccaggctggagtgcagtggcgcaatcttggctcactgcaaactctatctccccgattcaagtgatcctcctgcctcagcctcccaattagctgagattacaggcacctgccaccatgcccagctgatttttgtattttttagtagagagggggtttcaccatgtgttgcccaggctgatctcgaactcctgaactcaggtgatcctcccgcctcgcctcccagagtgccgcaattacaggcgtgagccaccatgcccttttctgtagagttggggatagtgctgagctcaggttccttgcaggaagcagccccaggggccgtgtaccaggtgctgctagtgggaagcacgctgctgaaggaagtgccttccgggctgcaggtactaagcccagttggctaggggtagaggtggggtgcctccccccaggcctgggtcacaacaccttcttctcctgtagctggagcagttgccttctcagagcctgctgacccacatcccaacggcggggctgcccacttcgctaggaggaggcctgccttactgccaccaggcctggctggatttccgaagggtcagtacactgggtggggcatgggggcagtcatataggcaacttgggatcatggaggagcctctctggggctggcttgaaccagacaaagctggctgcagtggcctggaacccaggaagcccaggaccaacactgcatgctgctccggtcatgcctgcccctgcttacagcggctggaagctctactacagaactgccaggcagcttgtgccctgctccagggggccatcgaaagtgtgaaggctgtgccccagcccatggagcctggggtgagtgtcccctcccagtccctccatgaatgctccctgtctccctccttctctcccatggccacctccacagcttattgccctcaatcacaggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggtgagtgcaagcccggcccccagatcttgccccagcccaccatattctatgccaggactcatctggctagctcagaacctggtaggactgtggtgccaggacagggtggagtggtgcaaggcagggggtctaagatggtataccctacaccaggacggcaatggacaaggctgacgagctatatgaccgggtggatggattgctgcaccaactgaccctgcagagcaaccagcgaatacaggccctagagttggtccaaacactggaggcccgggaaagcggactgcaccaggtcggaactacttgcccagagtgggccctgccccgatctcagacgtgagcccccagtccatagcagctctcttcacttttccctgcttgtgctcctccagattgaagtgtggctgcagcaggtgggctggccagcactggaggaggctggggagccctcgctggacatgctgctccaggcccaaggctcttttcaggagctgtaccaggttgcccaggtatatgtggtcacttgttcatgccacgggtattgggatgcaatgccaggaactaggaatgcagaactgtgtgaaagcaattcaatcctttgctttcttagaccttatagtcccatagaagatatcagttgtaattaatcacagtcatatatgtgcctgtaaacccaggcaagatctctggagagaatcagtgcaggtgattctgcctgagggtataaccaagactttacccagcaggagtgtcaggcaagctttttttgggtgatttttgagctgagagttgaaagataagttgaggtcaaccaggcagaagagggttgaggatgggggcacattccaggcttggaagatagcatgtgcaaaggtcctgtggcaggatggaggacggtgtgcctgaggaatcataaggccagtgaggttgaaatgcagagcagagaggaagaaagagttgggggagttgcggtgggacaagcctggtcagtggccacatcactgggccctgtagcagtcagtgtggagtttaatcaggaaggccatgtaatcagatccatattctaggaagattgccttcgtttccgagtagacagtgacttggaggatgggcatggggagtgcagtgaagaggcaattgcagtagtctaggtgggaaatagtgcctcctctggccaggatagtggcaggggagacgggttggagaagttgatgggatttgctatgtacccatgtgggagggtaagggacaaggatgttgcaaggatgaatgggtgctgttccctgagagactaggagatgaggtcatcttgggggaagggcattcaagagtccggtcttgggcatgctcgagatggctgtgagggatgagaggagggcccttgggtcttgggcctggagctcagaggagaggtctagctggagaggatcacttggtgggtccaggtgtttggatgacatttgaagttggtcacacaagagtgcctgggagagcgagtgcactgtcctcaggatccccagtgtttaatggcctaggtgagggaaggggagcaggacgagccaccagagaagagtgaggagaatcaggagcgtggggaggagctgggggagcccagtagagagtgggctgaatgacgctgagagttggagtcagtgaggcctgagaagcgctggggacggggcagagtggagctggagagggctggtgcggagggcgagacgagacggtgaggacagatgattcctctaggaactttggctgtggagaaggggagtggatgtgggtggggagtaggagatacgggtagatgttccaccacaggacagacttgatggggacatgtcgatatgtcagcaggaagtatctgagtctgggggctagaccgccaggcctgggctggctgagcctagtctctgtctctgcaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggtgggtgagagtctccccagctccaagtgatccatgaggccggagggatggcagccccagcttcagcagagcctgagcttttcttggtcatgctgcctgttctcttccctggtcttcagtttgaccctaaaacccagtcactggggctgtgtcctggacagcatcctgtggggatggggagtgggtagaggagcagagtgcccagcaggcttggcaggatcttcctctaatgcttgtccggccctggtgttgcaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggtatgggcagtaggcagggcggggagggcagtaaaggagagatgtcttgggtcctgactccccatacctggtaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatgtaagcccgacaggccatgtggtatcagctcgttctgccacactcccgaagttgctgctgggcacatgcttggtgccagtccctgtgctatgagtatagctatgagcaagactggcaggctcctgcacctgagggtgctcttagtccagtagaggagacatagaagcaagaacgatacttgtagattatagttggggctaggaggaaaataagcaggatagatgcttgtgaattactggcggggcaggggctccactttagagggcctgagtgcggtgccaggacacctggtacaagaggaagtctttgagaggctgatgtttaagctgaggaataggggaggggctggagtgagtgtcccacccagaggaaagagcaagtacaaggtcgtgtggaggaaagggggcctgccaaggaggtggctgagtgtagtgagcaggacagtcccaggtgaggtgagctcttagagccgtgggaggagcagagctgaaggcaggagctcagtctgagggcaaggggcttcttccttgggggcctgtgggcacaccccctttgcccagtactgttcttgccaaatcaccccttgttcaaagcagggaagactgggtctgtaggggaggcctccctaagaggcatctactggcattttggtcctctcaagctgagggtggtctagcctgtgccagccttagggagctggcccctttgcactggggctgagccacatgtccttgtagagggtgcagtttgggatgtacgcgctctacagcaagaataagcctcgctccgatgccctgatgtcaagctatgggcacaccttcttcaaggtaagtgaacctgagattaggaggagtaggggatgcggggagtgcccccaaaccactcagtggcctcccatccgcccacaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgtgagtcatcccagggcaagggcagtgggtgtgaagaagaaggcagaagaggctggccacccaccagcccccaactctgcaggttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaaggtaggcctgcccaccccaggccccaccacttgttttcccgccccatgccttaccaagcccctctctcccgctggccacagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaagggtgggtccatgcccctccttcacgccacactcccctcactggagagcttacattgacccacaggagcccagagacctgggaaaagctcgggaagtggggagaaggcccagcgacagccaccagtgcaggagaaaggatttcaaagccaggcagccttgctgtcactgcctctgactttggacacaacgtgaacttctctgaatataaggggcatcatggctctctctctctttatttttggagacagggtctcgctctgtcgcccaggatggcgtgcagtggcatgatctttgctcattgtagcctctgcctcctgagctcaagcattcttcccacctaagcctcccaagtagctgagactacaggcatgtgccaccatgcctaatttgtaaaattttttcatagaggtctcattatattgcccagactggtcttgaactcctgggctcaaacaatcctcctacctcggcctcccaaagtgttgggattacaggcgtgagccactgcgcccagccaggggcctcatctttaaaaggggaatatggcacctgccccacaggattgttgggaggagagcacctggcactagaaaggctcagctcacaggacagttaatgtgctggatggaggtgtacaggaaagacttatctggggggtggtagaggcccaaggacaggcttatgtccagaagcatcccacttatgtccactctccacccagaggtgcgcatggctgagatggtgtccatgggtgtggggaacaaggccttccgagacattgctcccagcgaggaagccatcaacgaccgcaccgtcaactatgtcctgaagtgccgaggtagcaggcaggctacagggtgtgggggtgggagtaggaaagctgtgcgggaagcactgtggccctccattagtgctggcccgcactttccttgggatctggggccaggctaggctctggcctgtcccaacctgaccctctctcttatgcagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgagtatgtctgggcctagccagaggcaggagggcatggcttggggtctggggcttcccgtgctgacagttcacccagtctccctccctagctgctgaggactcagagatctcgtcccaatgcccatcagccagtggctccagtggctctgacagcagctgtgtgtcagggcaggccctgggtaggggcctggaggacttaccctgtgtgagtgccatttgccctatacccaccagcccttccccagcccaagctgagcctgtgactgtgaccagcccctccccagcccaggctaggcctttactttgggtagagcttggggtgggtgggccagagccattccccagacacctcctgggtccagagtcagggaagcaggcattcatgcctggcctggccctgcaggtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgcattctgggctatctccaattaaaatgagacttggcgggtggggcatgaggggctgcatctctgggcaccctagtcctcttgtaggtactttcccaggatggagtaagagacagacctagacaggcccctctggatgagcaggtccatgcatcggccatatttcctggcgaagggcagtgtaagctggaaggaaaggccagtcttatccctgatttcctggccagttgtctactctagctccatgtgggtggggttctcccattggggcagggacagggcaagcccggctgttggggacttttgatgctctagggcccagctctgccccagggcatctcacagggtggggctagaaatggctatcagggaacaaagcagaaagaccggaggttcaaaaatctgtttcctgctactggttttctgctttttagccatacatgctgacttcacctttacaaaccacatatgagccagatgcctaatggtaactgggtactagagggcttgtggtgaaaggtgttataataatgctcttgattatagaagtgtcagatcaatgagaaactgcctaaatcgtttcggcctcaatgttaaaattagattaaggaatcagaaaaggaaaaagaaaaaaacccttgatcattcctttgcccttactgaatattttcttttttttttttttttttttttttttttgagacggagtctcgctctgtcacccaggctggagtgcagtggcacgatctcggctcactacaagctccgcctcccgggtttacgccattctcctgcctcagcctcctgagtagctgggactacaggcgcccaccaccacgcctggctaatttttttgtgttttcagtagagacggggtttcactgtgttagccaggatggtctcgatctcctgacctcatgatccacccgcctcggcctcccaaagtgctgggattacaggcgtgagccaccgcgcccggcctaagaatgcttaaaagtagtttagaaatgaaaggaatgtacacaattggtgacatcgtggccagataggtgaagctggtatcactggttgaaaaggcctcactcccatatgagtcaaagcttgggctcatatgatatgtgtccctaagtgtggccagggttgttagtgatgaaggcacagctggtatcattggaggaaaactgtaaaaaccagtggcctgaatactgcttttggactactctggattggttaatttcatgcagtttctccctccctgggagcagtggcctaagctgcctgtctagccttctgggcagtgctggcccagccctggtgcagcaagacacacgtccatctgaggcatccacagggtcggtggattcccagggattgcaagtggccctcacctccacccagctgtacaggcgctcctgggtgtgccggtcatccttgaagccggtgatggccagcaaatctaccacaaactgcttggggctgatgtgcagggtctgccaggagagcccacagtcaggcagtgctagggcagctcctagcccctcagagtgagatgcagagtggggacttctctgggcccacagagccacaggggtagggggcgggcactgtcactgcaaatctgcctcttggccgaggctcagtccaggtgcaactgctctgcttgcctccctgtcccaccactcttctggccctggccttctccttaaccccatcttggcttacttcctcttgccttgcaccacttattgtggggcaggggaagaggtggagaaggtacagggtgccccagggcctgaggcctgtcacacatacccacagccgattggccagggagaccaccttggctgtgatggctttggggtccttttgcctgatggaatccatgatgatgtcagccaggaagcagtgacatttctgtgcataaaacatctcttcccaggacagagagaaactcaggaaagtcacttctgtggaggagggaaagtggatgtggccacatctgtcaatagctagggccttagagacagtgtgaggagggggagaggggtagggcccccaggggccactgtctctgcctgaagtaccctgggagggggctcaggcatcctcacgaggaggcgcagggctcggcctggctccagagcctcaccttggggctggggactggctgtgggtgttgtgtgcctgaggttgtccatctccgtggtatagatgatgctgtcctcaaagaacatgcagaagccatcgctgcccaccacgggggggtgagtcactttgaggataacccctaggctgtccacctcactggcctcgggcagaggctgctcaggggcagggctttctgtgaaaacaacatagggagggggctctccttttaaaaaaaaattttttttcaagatagagttttgcttttgttgcccaggctggagtgcaatggcacaatcttggctcactgcaacctctgcctcccaggttccagcgattctcctgcctcagcctcctgagtagctgggattacaggcacctgccaccacgcccggctaatttttgtatttttggtagagatggggtttcaccaggctggtctcgaactcctgaccttaggtgatccacccgcctcagcctcccaaagtgctgggattacaggcgtgagccacacgcacaggcttttaaaattcttttcttcaattaccatcaaatcttcataagcagggactctccttaagccacctcagagcccaagcaggaaggggacctctggtgacaggccagtacaatcaagtcaccccagccttgcaacagctgccacctctagtttctcagaagtgacaccctgggctggcaggggcctgtcctggccactcctctcttcattgccctggcatcactgcaagccaaatcctgaacattttggaactcgaagaaactccagattcctctgttgaactaagacgtatcaaatggggctgagggctggaaatctttataaaattttaagttgagaacttttggggccagcctttgatgcatgtccaaagagtggacatttgtcatcccaaccttgacagaccaacttagggctcacaggcaagagtccaagaaggcccctccaagcagggctggagccactaatagggaaggtgacaatactgcaggcagggctttgagggagcagaggcagcatcctggcacagcgattttcagcacagttccctggccaccttcccttagctggctacacaagctctctctccagttcagtccctgtagcccctgctgtctcctgggcttctccacctggatgtccctcggcatttcacactcagtatgtgcccttccccaagctctgctctttctcttacccacacctcagtaagggcctatccacccccttgcagtcccacaggctagaaacctggcttctccttggcccatccctccttccctccactacctgcctagcctgcttcccctagcctagaaagaactccaagtggcttcgaatacctagctcctgctgcatttcctctgctcctggagcaaactttctgatgggcacacctgaccccgtgctcttgtctaaaatccttcagacgctgctcactcccatcctggtcagaatggagtaccacgtcctgaagctggcccacgaggcctgtccttatgacttctgtcttcagcctcatcttttatcacgtctgcatgtgaagcctggcctccagctagacccatgccctgcgcttccaaacatcctggacttctccttccttcccctgctgactccccagccctcagcctcttttgtgctcctgcttcataggcacctccttcccacagcactcatcccttcgccgtgtgtgttctcctggcccctccagccatgccaatgtgccagtcatttctgtgtctgctgcctggcacagagatggcattggtgagcgggggggtctagtcctcctttgtcactaacttgctctgccatcttggccaaagagtttgccttctctgttgtgaataagacttagatcaaagggggacaggactcacctctctccttggtcctctgcttgctccagtccttcagggtgccagctctttttgggggtaagtatggcttgaaggttggctctggccccttgtctttcgctccagctccagcccctgcctgtggtcctggatccttctctgaggctgtggaatgggctttccaggcagctgaggtgctgggctgggaagcagcctcgcttcccaaggggagctgcagggtggcctcctccaaggggctgctccgtgtggctgtcagtggctggaattcccactgtttgcaattgaccatgtcccattctctcaccagggagatgagtttttgcatgggagtggcgggagggtctttggtttcagatttctgtgtgaggttgattgtggtgcatttcttctttggggggctctcagggtggctcccccagtgtccaggattggtacacaagccacggcagtgtgagtatgtgctagggttgccagccctcttggcatttcggcatagggacacctggatgggccgagtgtactgctcagcctcatccatctggttggacctgaccaggtttcccttagccttgttccatggagtcctgtcactgcagtcttcgaagtccacaggcatgtaggctgtggtctggggagggaagggcacagtaactctggataggttgggcatggacatcaacgccttgcccaagatctaataagctgggcctccaagacttcacttgctctccctgaacaatcccatccctgacaggggtcacccatttgagctttgctcaggctgagtggggatggtgccagcccagtggcctgtcattccaacaggagatacaatcagcatcgcaggccacaagtggccagtaagttcctgtgcctccttcacggttcagaagccaggtcctgtcctaggaacccatgtaggctctgctctttcattttgctgcacccaccagtagctgaacctacccccatccaccctgagcccggtggtagtggtttttgaggataacaccaaccagaggaggctggtgcttacttctttagtgtctctactgaactccaccagtgaccctggcccttctgtcaccacatgcagcctcctgatggaaaaagcttcttcattttcagattctttctcctgagtccatgacctgcagaaaccaagaggggttggttagtgagtagagacttccatcaggccattggccagttggtcagatctgctctttggctgggagttaatgctagacagcagggaagaaggggctcttaaagggttttgcctaggtcactggccaatcctgggcctgcttcactccctcaaccccaaggagatcaggatcctctaggagtaggacttaggacaggatttcaagaggaatttaaaggaccaaattctaaacatagagtcgtgataaagttttcttacttgtatgcttcacattgtgcaagggcttctgagagggatggaatgtggtattcctccacctcctggcagaagaggggccattccctgcaaacaacaaggagatatccagctgggcagctaggatgagggtgtgggagggagcatgagctcctggaactgccgctgccaacagttcccacgatggaaataaaataacctcctccctgaaggctgcaactcaggtctcctttgttgctaagggaggggtcagccttcgtgatttcatcttactgcgtccttgcttcacttacttaaattcagatggtaaaaacagtttgccaagtctcaggaagttgagaatgtgtcggaacatctggccatccccgtggatgagcagggtttgtccatatgtgatccagtacactctctgagggttggacagcagttctggatactggagggggttggacaccggactcagtctcagaggctaggtctttgcgaaggggcaggtcaatcttctctcactccccttttccaactacactagagcagaggctttgagattccatttccctgtcttgtcagtcacaaggaaccatggtggggagcagagcttccagggagaagcacatcatccctgcttcaacttttgatggcccctagaccaccctctcaaggcatttggaagcccaccgtacctccttctcagtccaggtccctcagagctggccccctccctatgcaaactctggagggccttcccagcaggccactcggtccacttgtgctctgttttgttttgttttttgaggcagagtcacactccgtcacccaggttggagtgcagtggcgcgatctcagctcactgcaacttctatctcctgggttcaaacaattctggtgcttcagcctcccaagtatctgggattacaggcacgtgccatcacacccagctaatttttgtatttttagtacagacggggtttcaccatgttggtcaggctggtcttgaactcctgatctcgtgatctgcccacctcagcctcccaaagtgctgggattacaggcatgagccaccgtgcctggcgggaaagcctttgttctaagcaagtgctggaagctgtgtgagggccaggtgatggcccccagagcagctcaggtggtgatgccagatggggagcagggcagccgaggccgtcagtaccttcagcagtgtctgcagggtggttgcgtaccagtggcttccaacatacactttgatgatctgttgtggggaatacacagtgatctctgccgtccactcatctatgggaatccaggagatagaacacatcatcatatggccagaagggaaagcaggtagggccctttggttagtagtgtatttcacgttaagtctcaatatctttcctcagtcatattgtgttgcctagtctgagaagcagcagaaatccctgacataaaccttgcttgctgcaaggtttcctgggtggtgaggcgggaaagggcactgcccctcttcacctgaccctcctccctcaggaaagctgggttgatgaccctgtccacctacaatgccagctgcctccggtttctggttgggtgtgtcctgagtgtgtagcttttcatgtggccactcagactgaagctaggaatctctctctgtgtgtttatgttcgtggtttggcaaatgtcatggagccaactctcatcaaatccctgtcacttttatgagactaagcctctaggcatgtctggagaatgggggctgtatgctggaaagatgaacccataacccttttcctggagatgactatatgtaggccttgttctgatgtttgggaagcagtttctaatgagctctgtaatgaatgaagggtatataactagattatataaccaagagataagatgtatagaactagaccgtgaactccaggaagaaagggactaagtctgtgttgcttacttctgtgccgccagtgtctactgctgtcctggtatatgaccggtactcaataaatgttggatgctgctaaatgatagtaatacagcttaaactttgtcccccaaatttttggtaataagaagttataggcagctggtgaaaacaacattagctttggactcagtcaaaccccagcttgaccactgtgtaacttgagtgagttttcttctctgaacctattttttggctgttaaatggacccagggacagctctgtttaacagaggaggctcctccctgcatggctgtgagaagcacagcaagtcagctcccagggtcaaggcaggcctgccctgggggtcctgcgtggccccagactgggtaacagccctgtctgctgctggagacgaattgtgggcttggaggtgaggagggagcacttaatatgaaagtttcccttttgtaaaaatccaaaatattggcctggctttcccctcctcctccatctacagttcctcgtcctggccacatcatctattccctccaatctcccagatactcccctgatgctaaattcaaacctagaagctttctcacttactgagcacatccatgggtgccaaagtccttggctccagatgagtcttcaaagcaactttgattggctcgtaggtgatgtcccttttgtctaggaaggcacagagctcatatacctcggaaatggtctctgtcaggggcagccggcaagtccccagccagttcctgcccagaggaaaggtctgtcatgaagaacatcagcattgtaccccaagagagtcgagcctgtaaactttccatgcctaggatgccttgccgcaacactggcttaaatcaggcatcattaacatcgtttccttgtattttttttttagatggagtctcactctgtcgccaggctgaagtgcagtgacgcaatcttggctcactgcaacctttgcctcccaggttcaagcaattctcctgcctcagcctcccaagtagctggaactacaggcacccgccaccacgcctggctaattttttgtatttttagtagagacggggtttctttttttttttttttctttttttgagacggagtctaactctgtcacccaggctggagtgcagtggcgcgatctcggctcactgcaagctccgcctccagggttcatgccattctcctacctcagcctcctgagtagctgggactacaggcacccgccaccatgcccggctaattttttgtatttttagtagagacggggtttcaccatgtaggccaggatggtctcaatctcttgacctcatgatctgcttgccttggcctcccaaagtgctgggattacaggtgtgagccaccgcgcccagcccgtttccttgttttaactggaaatctgtttaaccttgtaggagagtaagcctggacaaccggtcacatttttggagctgagcttgacttatttcagcaaagccctctaaatggactaatttcatgtctccaggccgtgtttccggttccagggccagcccagggcccagtcgctcccttcttgcctcatacgcatctgcccaagacatctcagtcactgtgttgcagcctgccacggtcttggaaaaaggctggggtctaaacatcaacccccttctccaaaccctcccttccaaggcacttgtctttgccctctgtgacatcagggtggacatctctgaaagatatggactttatgggctaaaagagcccaaaacaacaatattgggaaaagacagcattcagggtcagctgaccctctcccaggggctccagaaaacccacttctaccttccattttggtgccagtctgttttgtgaccctcagagagttgctctgctgttctgcacctcagtttgcccatctacaaaacagggttggattccttgcccctgcactaatgaggacatcctgagctcatcccataaggcaaaggctgaggatcagcacctctgggaagcctggcctggcctggcctgccctgccctgcttctaagggggctcacccctggctctggccattctgtgtgtccagtgagcctcccaagagtggcggaggacctttgtagaggggtctgcacagggaggtacccagctccctgactgtggcctggtcacctcagacctagcacagggctagaaccagggaaatggactgcagaggacagaaataggaaatggtctgaagcctttgaaccttggcaacccttgtaccttggcactagccctctcctttgaggccctaacctggtggtagtgtggcggtgctggtgatggtaatggctaaaatgatgggctggccccaaggacacacttcacctctggctagtgggaaaggccccaggttattcctagagggaagggcagagccaagggtgatgggactcagtgtgccctaaggaggacctcacttgacgtgctgaaagaggacgccattccctgtgatgtacagtcggcttccgtctagcgtgctctcgatgcgaagctggcccagcgcagagtccgggtacttgaccagcagacccagggccattgtgtagagcggtttcacggactccaggctggctgtgcgggcccccttcccggggctcaggggagaacaggtggtcggggaacagccacctgtgtcagagagaaaggggtgactcctaggccccccatggtcatagctggattggaggctttggggctcggttcctactgctgcctccattgtaccgaggaggctcagaggaaggatatttctttgcacagtccaaatcaagatcttctcaaaattagtataatttttttgtatactcaggcttagaagtcataactatttgttgggaggtgagttgggagtggggggattcatttgctgtatcactagcatctgaatttcctaagtttcaggaaagcagccatctggccctagcctctgcaggagtcttcattagttccaagctcttctgtaaccatccaaaggtaaagaacggcaaccatggcctggaaactcaatgtgtgttacaggcttcctggattcacagcccctgttgctggctctcctgggcagaatttcccccagagacatactgtgtggcattattttcagggtgggtatttgggttgctggtttatggatgggacctttttctcctatagtgggcctagggtacagtccagagaatacagttatcacagccttcaggaccctgctcccgtggcaacaatgtgccagtgggcacactgctgggggatgttcgtggatcatctccaatcctcagagcaaccctgcaagaggggatagtgctatcatcatttcacgttgaagaacctgccctgagaggctaatgaagtatcttgccctaaactgcaaagctaggcaggggcagggctaggatttgaggtcagctctgtccagctccaaggttaccacagctgtttcccttattgtgatgctttgtagaaagctaaagccaccctttgtgtttgaggagtgctgccagctcccagagcctggctgtcaacacacttcctccatctttgcattgctctgtggagcagggactacgctaccatctcacaatgatctatgttctctgaggagtagaaggctttgagggaaggggctgaactcacaccatcttaagcggattataaggccctgggacagggtcctgagacctgctggagcatgccactccccacaaagaggatgggtttcttttttgagaaggagtctcactctgttgcccaggcttgagtgcagtggcatgatctcggctcactgcagcctccacctcctgggttcaagcgattctcctgcctcagcttcccaagtagtgggattacaggtgcgtgccaccatgcccggctaatttttgtattttagtagagatggggtttcaccatgttggccaggctggtctcgaactcctgacctcaagtgagccacttgcgttggcctctcaaaatgctgagattacaggcatcagccaccagcgcctggccaagaggatgggtttctatttgtctgggagaaggctgggaaatctatgcctgaagataaggaaaggcctgattgccatgggataaatgtctggtgatgtccaggccaaacttcccatgtgcaatgcagttctacacattctcgggatggtggctgaagccatgctcaggtagcttgcgccctataacatgcacagtagcttccatggaggtggagttgggaaatggaatgatgaacagccctgaggaaaccatgaggggaagaacaagctggaatgaggtagggctgggagcacgaaggcctaggctggacaggggtcagcaagcgtcaggaataggcagaaacaggcacagcagccgggggtttccacgtgaggtgacgagggaatttgggggtggatgagatgcatgaagcactgagcatttcccacacctccaaccgtgcctggaagaggaaggatgggagtggctggtgggtgctcttagtccccaccactttcacaagcagggcagacctcccctgcccctgagaagcctgccttcaggcccaggacattccagcctggctccccacccaggctgggctcctcctgatccaggctgggctgggctttctacacccctggctggttgcccactccccaccctcagtgggaaggctgagccggcagggcagcacacagggtttcaggctgtgaatcctcttcttggattcagagtcagccagaaaacccaatcctctcactaacccccaaagcccgaagtgattgtgggagggaagattgttcttggcttttccaggtcaagccaagactgtcgagggggagccaaggtttcctggcgacatacccatgttcatccggtaccaccttacggcttcagtgagtgcagggatttccagaatttccacttctgcttctaatacatcaatgttggagaaattatccggtagtaaaatcttctgtgagcgaagaaaattcacttgaaaaacaaaggggaacacagtgagttaatgaggctatttctggtttagctgtaggtcctggttttggcaggtttctggtgctgtaacttatcctaggttctccttgttctgaaacaacttatcaacataccttattagattagctttgagtgtgtggttttcaaggcgaaagaccccacattactttgttttcctgtgtctgaggccgtgggtgtggcctcccgtggcttggcctggggctcccaagccaggccctcctggtgggcacactggccctgagacttaccctgtgagttttgacccaagagcaggtcattccaaaagagggagttgtcttgctgcttagagaggaggggcccggccgagcctgggctggcgggtggcacttgcagtttgtccctgcctggactgcagtatgggaggcagagatggagccaacgctaatgtcctgtgtgaatcaacttagagatacagaagcacatcacagacaactttctaggtgactatgaatatgaatgactggggttccagacatttgggctcctagtgtaacttgagtgtttactgccctatctatctagacagcagtagcatcttggggtcaaagagatcattcagttcacatcccaaacagagctcatcctggggcagtagggggagagaggctctctctgtcaaaggtggaaaatctcatccttccttaggccactacctcaagtggacaattctgctatgactctgggggaacctgtcaccatccaccctccttcccttttattctgagtttgctgacattaagagcaggtagcaccatcctttgaaacaatctggattcctcattttatggtgagaggaactgaggccggaagaccagctggatacataagggcagagtaagaagagaagccgactggcaaccagctgagctccctgcccttcacaccaactcctgtggtccctagcactttccagtgcctgacacttttacagccaggccatcccaaaacaaatagggaataaaacagccctgagtctagtgagattctaatgctggaatctgcttgcttcctggaaggctctgtcatgcttccgctacctctgcccagggaagctcctgaggccctgagcaccaagctgggcctctgtgggacatgtgatggggaggggtgaatgggccctatcagcccgccccccaccccaccccggacagagcaatcaccaatgaagcggaactcgctgcactcgcactcgatgagggccaccgtctcagccagccacagcaggttgtcttcagtcactaggctgggatatttggccaccaggtctaggggcaggaagcagtagtgcacctcctcttctgtgtctaacaggggtgtgtccatgagccccagaggtgccttatcatgtaggcctggaagagaacatgcaggcagtgttgccacctctcagaagccagggatctgattccagcagggctttcactgacccaggggccccagaggatgctagagagaccccccaggatatggtccttgccacttgccagacacatcttccttctttatcttttcagttgtagccctaaggagtgtggtagggagtggggcatggaagtctatttttttttcttttcttttttgagatggagtctcactctgttgcccaggctggaattcagtggtgccatcttggctcactgcaacctctgtctctcagattcaactggttctcctgcctcagcctcccaagtagctgggactacaggcacgtgccaccacacccagctaatttttgtgttttcagtagagacggggtttcaccatgttgtcaggctggtctcgaactcctgacctcacgtgatccatctgcctcagcctcccaaaatgctgggattacaggcatgagccaccgtgcccagctggaaatctatattttttctataaacagtgaagggcagtgggacatgtgacattttgacttatgtatccaaagtcattaaattcatttacccatttgattctaattgatcaaaccaaacacagtgatccacagacaaaatagatgcttttgacactcctggaagctaaaatccatcaataatcataaatgctttgtactcatgtctcagataggctgaactatgctgccaggcacccatcagacagtgattatttagggacattctgtgtgtggtggttggaggaaactcaaaagaatggtggcattccctgatgaataggagggagtggaatgaaacctcgccttgcccacatgaagccagaatgcagaggagtgagtgtggaggagaatgttggttccagcaggcaagcagccatggagagggcctgtggcagggcagaagatcaaaggagatgacagagactgcctcagaaatcaggcactctctgctctctggatggaagccacttctgttagggtgaggagagggaaagttggtgtgggctttagggagggacagcctatcccaattcacctgtaaaggctgggcttttaattggaaattctgagggtttgctaatacacttccatgtacgccagtagttcagagatgctctctcagcaacaggtaggtctgcaggccgtacgcgtagatggtgtttcccttccttcaggttatctagagtctgttagataatgaagagtactatcttgagaatctaaaccaagtaactatgtaccaattctagtgtgaagatcaggaaaaacagtatgtgacttacttttttttttttttgagacagagtctcgttttgttgcccaggctggagtgcagtggtgcgatctcagctcactgcaacctccacctcctgggttcaagcgattctcctgcctcagcctctcgagtagctgggattacaggcacctgccaccacgcctggctaatttttttttgtatttttagtagagacagagtttcaccatgttggccaggctggtcttgaactcctgacctcaggtgatccatccgcctcggcctcccaaagggttgagattacgggcatgaaccaccgcgcccagcgacttactttaagtgttttgaaataaattaggcagtcacacaaaaaatgtaaaaatgtagggctatagggtgacatgctgatattcaaagtcccaatgattatttctcttctgatttttgaaacaagttttgttataattttatgttgagtaatagtaatttatcttgcacaatctaaagagtaatttctatttaatcattaaaaacttgttattttctgctatcattttccttcaagtgctcaaaatcactttcaacctgttataattgtgatttgctattgtttgtgttcatcctaaccctgggtagtgatctaagtggtgagattgaggtataataaacatgtcttatattgccacaggactccacatttttcaacacactttaacacactttttctcatttaccatgacatgattctgtgagacagatgtggttggtgagtgtcttactgatgaggcagctgaggtcaaaggctttgtggcccgcccaagcagtcttccaagtccagagcttgtcagcttgaaggatcaggcgaccagaggtgggctgaggctggagtggagcaccccaactaggcaagcctgaagcccagggcggtcttcgtgccgcccttacccagggacccattctccctcaaaagtcctgcagggggcagattatcataacatcagcaccccctccctttttttttctgtctttacgctagaagaagatacatagtattttcccaataaatttccggatatagcagggcaagtggtactttaaaggcaccagatcctcaaaatggacaggtgccccagatttagtctgaaactaacaaataatctgcctctaaatgctgctatgtcaatgaagcccttgtgacgttgctctcaaaaatcctgagcattgagactagtcctctggtggccaagctataaactgtgcccgcataatcacttaaggtcaatgcaaaagaaggcgggccagagtgggagaatctttcccactctggatggctggagggtttgcaaaagcactgggcaatggtgggatcgtggggagtgctttcctgtggcagtgaacaatgggggagacagtgtgtgcgtggaacgctggaagacagtctgtcattcatttgagaaatactcattgtgcatcaccagggccacagtcagacactgtgcctgccctcaagaagctctcagcttgggagagaagaaagatatgaaagaccacaatttacgtatactgagattagagccagtgtcaattatgaagtttctggacctccaggaaccctgggatttctttccacagcattagaagggaacattagagtctcgctctgtcacccaggctggagtgcagtggtgcaatctcggctcactgcaacctccgcctcctgggttcaagtgattctcctgccttagcctcccgagtacctgggattacaggtgcccaccaccatgcctggctaatttttggatttctagtagagatggggtttcaccatgttggccaggctggtctcaaactcctggcctcaaatgatccaccagcctcggctggtgctgggattataggcgtgagccaccgtgcccgtcctgcctctccattttctctcctttcctttcccctagtcctggtcccctagcccccaggtcctctccacacagtgatcttgcaaacatatgaggtgagtccaaatcactcctcatcttaaaaaactttagtgcttcctgttgctatgggataaatccagactctcctttgcattgcacatagggtccttcacaatcaatggagggagtagggtatacacgaaaagaacaagggctttgaactcagcatatctggggtaaattctgactctgtcacttaaaagctaacatttattacccatggacttttaaactgaatccttccaatcttcccctgacaacaaagtaggctctggtatcatcactccctttgagcacatgggaagctaggtccaggaagaggtaggggactaagtgcaccaagtaagtggagatactaggaatgaaacccaggactctggagcccaagcccttagcaactgttttctttttattgatatgtaatagttgttcatatttttggggtacatgtgatatttcaatacatggatacaatgtataatgattaatttagggtaatgaagatatccatcacgtcattttttttttttgagacagagtcacactctatcacctaggctggagtgcagtggcatgatcacagctcactgcagccttgacctactgggctcaactgatcctcccacctcaccctcctgagtagctgggaccacaggtgcacatcacaacaccctgctaattttttttttttttttgagacaaggtctcactctgttgcccaggctggagggcagtggcccaatcttgacttactgcaacctccgcctcccaggctcaggtgatcctcccacctcagcctcccaaacagctgggaccacaggcgtgcaccaccacacctggctaatttttttgtatttttagtagaggtggggtttcgccacattgccctggctggtctcaaactcctggactcaagtgatcggcctgcttcagcctcccaaagtactgggattgcaggcatgagccaccacgcctggccgacagccagctaagttttaagttttttgtaaagacagggctttgccatgttgcccaggctggtcttgaactcctgggctcaagcgatcctcccatattggcctcctgggattataggcatgaaccactgggccagacccatcacctcaaacatttatcttttctttgtgatggaaacattccaatgattttcttctagctagtttgaaatacacaatatattattattaactatagtattcctagcgtactaccaaatacaagaacttattccttttatctgactgtaattttgtacccattatccaaattctcttcatctccttccctccccctacttttcccagcctctgctgccttccacttgtcatgtaacttctccaagcctcaggttcctcactggcaaagtggaggcagtaaaatctggaagctgttgtaaagattaaatgaaatagtatgttaatttccttccttttggaggtcatatcctaaatttcttccttccttccttcctccctccctcccatcctccctccttccttccttctttcttttctttttttttttttttagtgccttgctgtgtcgcccaagctggagtgcagtcgtacaatcatcatggctcattgcagccttgacctcttgggcttaaacaatcctcctgcctcaacctcccaagtagctggaccacagctgtgcgccgcaacaccccattaactttttgattttttgtagagatgaggtcttgctatgtggcccaggctggtctcaaactccttagcttaaatgatcctcccacctcggcctcccaaagtgttgggattacaggcatgagccactgcgcccagcctaaattacctttccagcctcatttcccatcattctttatgtttacaccccatcatcagtgacactaaactccacaaaactccaaaaacacatcacgttctttgacacctccccagctttgtgtacgctgttccatctgcccagaatactcctccccattctcttcctgaagagcctggagcctctctgagccagaatgggtcatccccccactttgttcccacagacactcaacactttcacttctctctgcaggcctctggctcagtttcaggccagttcttccccctataccaagcttcctggggagaggctggtttgatgcatccccattttgtgttctagaacctagcatgcatatgaaagaatgcatgaaaatggagggctagccaggtgcggtggctcacacctgtaatcccagcactttgggaggccgagctgggccgatcacttgaggtcaggagtttgagacgagcctggccaacatggcaaaaccccaactctactaaatatacaaaaaattagccgggcttggtggtgcatgcctgtagtcccagctactctggaggctgaggcaatcatttgaacccaggaggcagaggtttcagtaagccgagatcatgccactgcactcaagcctaggagacagagcgagacttcagctcaaaaaaaaaaaaaaaagaaaaaagaaagaaagaaagaaaaggaagggctggagggctgattctctgcaaagaaaagcaaaaagaaacatgggagatctccaaagaagcgaacagagaagtagactgcactcataaaactgagaaagatggaaagacattgagtatccaaaaccacaggaaaaaccagcacaagattacaatgggcagagcctatggagttcagaggacaatgaagacagggattccacgttgggatctggaggccagagggaagacctaacggggagagggacagggatgaaggagagggagagaggatggcaagaagaaagggtttagcttgggtctgatttgtgatggacagaaagacagtaggcaaagtagcaagaaaagagtgaaactagggaaagtcagctagggcagcgtagcactccaagcccatgctcagtggactgcatcacaggagcttgaatctgccacttacttcacctacagattcaacccccaagattctgtcttagtggagaaaataatagtgcctttgaacaactctaaattggccacgtgggagaaggcctgtggtggggagaaggggagagaaatccctgcccaggacaacactcctatttggaggtgtttggtactggatgtgtcctctggaatgggtcagtagtgacagtctagctagtttgagaggagatgtgctagttgaggagagaatgatctattttgcagaaatgaaatctccatttcctgctatttccaagcatgtaaagtgttagcagcaccattttccccaagaaaggtatgcccaagaaatcttaaaaaagagaaaaactaaagcaagtccacaaagattgccatccttgccagtcaggtcatgctgcaggccaggcccaggcatcggccttgacctaggctcaggagcctcaacaaggctgtttcccgaactctgtcaaccaatacttgctctgacttctagaaatacaagtcctctactcacggaaagccattcgggtgctataagaaatcacagaaaccattccccagcccctcacttacttatttttgatctgccagtttcccctaatagatataacctccccaagacctcaggaccttggctgttttgtcctctgccgtatttgcagcacctaaaacaaggcctgtggggtctcaatacctttttgttcaatgaatggctaaatgaatgaagaacactccagagagcctgggcttccagctgccctctggctttgctgactgaaattgctacagagtgtgtggctggtcttctacaggctgacttcaagtccgctttcatctgcctgaatacaacttccaggaattttacttttcacatgttacgacctggaaaaagttattggagagaggatttcttaagggaaatacagaccttaaatgaattcagatggctaatttctagcacaagaataaatgatgttgcttttggcctagatagtggtgaaaaaatatgtcaatcagaagcaacataaaactgatggcacggggaagtatgtgtatgtatgtgtgtggttgccaaagatggctgacaaatgcgccctgatggcagaactttgggacttaacggaggttttccaaagcagcagcagttctcagagatgccttatgctctgatgtaggctgttggaaagaatgtgatggtaaaggagcttgggggaacttccaaatccttgactgccttgtaaagacaaggagggccagcactgctttaaggctcaaggaaagcaaggctggtagaacaaaaggatgtgcagaacagctgctgtcagcccccaaagccaaataagacgcagctttcggcatttaaaacctaccccttcactgtgggctccagtcacctcactctgcagaagtcatcttgagcataacactgagtgttctctcagcagatatgttgttaagcatgtgcaaatgccaggtactgtgagaggtgctaggtgtttgtttcatgaaaacatgaaaagagtacagcccagtgagggagaaagacatatgaatacatgagaatacatgatcacaacagaattagcactgctagaatgggggaattcagtctgttatgagagcagagagacaaaaactcaggaaatgtcaggatagtcttccagtgggccacatttaggccaaatctttttttttttgagatggagtctcactctgttgttcaagctagagtgcagtggcacaatcttggccttgtctcactgcaacctccgcctcccaggttcaagcgattctcctgcctcagcctcctaaatagctgggattacagttgcctgccaccacgcctggctaatttttgtagttttagtagagatggggtttcactatcttggccaagttggtctcaatctcctgacctcaagtgatccacctgcctcagcctcccagagttgggattacaggcgcgagccaccgtccccagccaaggccaaatcttaaaaggggagaaatccaagaagaggaaacggcaagtgaaaaagtgtagagagaaagcatgtggggtgcttggggcaaggctgaacttcaaagtgtgtgtgtgtgcctgtgtgtgtgtgtgtgcatgtgtatgtggccttgcctgcatgtaggtgtgtgtctttgttgggatatgagccagcacaagcagatgagccagcctgtgaggagccctgatgccacgtcaaggggtttgcatttgagtcatccacttacccacaccacagacaagctacacagttgggatgaatatctgctgtttatgtcatcctcttcctttccaagatcacagtcataatctcacatcatgagtaatgggaaatgtgagactgccactggtctattttcttaaaaacgtcatttgtgtgatcaacataaaaactccctggctcccttgagcacaaggaatgaaggcgtgtttgggttgcttgctggtagcagaatgctcacaagtggaacaatttaaagttccaaactgagaagtccccagaaggtgtgaaaaaggaaacataagtagcatgtcctgtcaacacattgtcctcagtggacttcaggggggaagtaaaaaagaatcgataatttgccatgaaacttaaaccctggtgaatgaccctaaagggaaattccacactctgcagctgtgactcccacccaggctgatggatgtgaagggctcagatcagtttacatttaggtaaggtggccttcccaaattacacaggaagttctaggaggccctgtgatattaatgtgtggacctgtaatgactactttgtatttcccctataaacaatatacagtattccaaaatatccagattcatggatttacatatcagcttttatgactcccaaatttttatctctaggcctaactgtttccatgaattccagacctgtacatcccgcgcctcctgtttaccttcacttggatggttttattgccctttcattgtctctcaaactcaacatgttcagatcctaactcctgattttcctccctaaacctgtgtacacatccctcaaaatccaccattcatctggttgctcaggagagaaacaaaggagttgtccattctctctcaccctacattcaattcatcagcaaaccctgtcagttctaccagcaagacatattcagagtttgaacacctctaacactactattaccaccatagaacaaaccaccattatctttcatctggatactgcaggagcctcttaactggtctgtctacttcctcccttgctctgctgcagtctaggccaggggtcagcaagtttttttctataaaaggcctgacagtaaatattttaggctttgctttgctagccacatggtctctgtcaactcaaccactcagctctgtgttacagcttgagagcagccatagacaacacataaacaaatgagcatagctgtgttccagtaaaactttatcaatggcactgaaattagaattttttttttttttttgagacagagtctccctcagtcgcccaggctggagtgcagtggtgcgatctcagctcactgcaaccaccgtctcctaggttcaagcgattctctcatctcagcctccccgagtagctgggattacaggcacttgtcatcatgcccggctaatttttgtattttagtagagatggggtttcaccatgttggccaggctggtcttgaactcctgacctcaggtgatctgcccgccttggcctcccaaagtgttaggattacaggcgtgagccaccacgcctggcctgaaatttgtatttcatatgatttttacatagcacaaaatatttttgattttttttcaaccatctaaaaatgtaaaacccattcttagctcatgggctttccaaaaaaggtagtggctgaatttcgtccatgggctgtagtttgcagattcttgatctaaggttaagccagcagccaatgatctttctttttatttggggatagagtcttgctctgctgcccaggctggagtgcagtggcatgatcttgactcactgcaacctccgcctcccgggttcaagcaattctcctgccttagcctcctgagtagctgggattacaggcgcatgccaccatgctcagctaattttgtatttttagtagagatggggtttcaccatgttggtcaggctggccgcctcagcctcccaaagtgctgggattacaggcatgagccactgcacccggcctttttttttttttttaaagagaagatcttgctgtgtcacccaggctgggatgcagtggtgaaatctcggctcactacagccttgaactcctgggctcatatgatcctctggcttcagccttctgagtagctgagactacaggcacatgctaccatgcctggataatttttaaattttttgtagagatgatgtctcattatgttgcccaggctggtatccaactcctggcctcaggtgatcttcccacctcagcatcccaaagtgttgagattacaggtgtgagccaccgtgcccagcccctctctccctccctccctcctccccttctttcttccttccttcttcccttccttcctttcttctctctctccctccctccctccttccccctctcttcccttcccttccttcctttctttcttttcctgagatatatttcacatactataaaacttacccatttaaagcatgcaattcagtggcttttaatctattaacagaatcaagcaaccatcaccacaatctacttcaatacccctaaaagaaaccctgtacccaataacagtcactgctcattctccattctcactcacccatccttcctaccctgagccccagccctaggaagccacttatctatcttctgtctctataaatttgcctgttctgcacattttagataaatagaatcatacaatatatggtgccattttatttatttatttgtttgtttgtttgttatagagatggggctttgtcatgttgcccaggctggtcttgaactcctaagctcaagggatccacccacctcggcctcccaaagtgctgggattataggcatgagccaccgcacccagctgtgtctatcttctatacatataatcatacaataagactgtttctttcacttagctgacatgatggtttttttcacttagcattatatatatatatatatatatatatatatatagagagagagagagagagagagagagagagagagagagagagaggggaagggtcttgctttgtcacccaggctggaacacagtggtgcaaacacagttcattgcagccttgacctccctggctcaggcgatcctcctgccttagcctcccaagtagttgggactataggcatgagccatcatgcctagctaaatttcttttttaattttttgtagagttggagtctcactttgttgcctaggctggtctcgaacttctggcttcaagcaatcctcctgcctcagcctccaagagctacctataacatttagaataaatcctgtgtcttcaccatggctttcaaggttctgcaagatctggcttcctctgatctcattgtcaacctttgacatctccctacctctcactgtactttacaatggcctccaagtgggccaacgagccactataacctcagggtattagcgtttaactattcctcttttttttttttttgggatagtctcactctgttgcccaggctggagtgccgtggctcaatctcagctccctgcaacctccacatcctggattcaagcgacactcctgcctcagcctccacagcagctaggattacaggcatgagccaccatgcccagctaatttttgtgtttttttgtttgtttttttgagacagagtcttgctctgttgcccaggctggagcacagtggcacgatctctgctcactgtaacctccgcctcccgggttcaagcaattcttctgcctcagcctcccaagtagctgggattataggcgcacgacaccatgcccggctaatttttatatttttagttgagatgggatttcaccatgttgtccaggctggtctcaaactcccgacctcgtgatcgcctgcctcggcctcccaaagtgctgggattacaggtgtgagccaccgtgcctggctaatttttttgttttttagcagagatggggtttctctatgttggccaggctggtctccaaccctgacctcaagtgatccacccacctcggactcccaaagtgctgggattataggtgtgagccaccgcgtctggcctaactattactaatgtctgtaagttctttccccagatacctgcatgccttacccctttgcccctttttcattcagatttctgctcaaatgttgccttgtcaatgaggcctgtttgatcactgttttcttatttatttaagtatttattgacaaggtctagctctgtcaccctggccgaagtgcagtggtgcaaatatggctcactgtggcctcaaactcctgggctcaagcaatcctcccacctcagtctcctgagtagctgggaccacaggcatgcaccatcatgtctggctaattaaaaaaatttttttgtagagacagcttttgccatgttgcccaggctggtcttgtcctgggctcaagaatcctcctgccttgacctcccaaagtgttgtgattgcaggtgtgagacaccatgcccagcctctgatcactcaatacagaagtcacttccctggctccagtcacttgctatcccccttacccttcttgccacatactatccatctgaatattaaaagacaagcagattcgatgtaaatgttttattctttcaactaaattctagtactagaaggacagtaaaacaatgatatgctggggaaaatgtagcaatatacttttgtttaaaagactgattgaataaacaaaaactacaaaaaaaaagaaaataatataaacataatctgaaattccaagaagtcctggaatacagaaatgccctcctccttcattattacacaggaagcactgttttaattgtcttcatagcatttatctctacctgacattgtatagctacagggttcactcctgtatctccagaacttggtgtaagtttggtgcttaatacacaataagacactaataagcatcaagtgtatcctttggaggccacaactacaggctagaggtgggggttgggtgggcaggtggagttgggggatttggggaatggggaggggtggagagcagagcagcagcgtgagcctgggtgcctgtactccagaagcttcccatcttgtgctgcttgttgatcattctacatggctttccatcaaagcctactatgtcacagataattctgagtagaatatgcatttgttgagtgcatgggaaccttagttagcaggaggcaaagtcacatttttattgttaggggctgaatctgaaggactctatggtgaggagtactaacagtttagagcagtttagatatatgctgcccaatatggtagccactagccacgtatggttattgactacttgaaatgtgacagtctgagacccagcacggtggctcacatctgtaatcccagcaatttgggaggctgaggggcagattgcttgaggccaggagtttgagacaagcctggccaacataacaaaaccccatctccactaaaaatataaaaattagctgggcgtggtgctgcacacctgtaatcctagctacttgggaggctgaggcatgagaagctcttgaaccagaaaacggaggttgccatgagccgagatagcaccactgcactctcacctgggcgacagagtgagactctgtctccaaaagaaaaaaaaaaaagaaagaaatgtgacagtctgaatctgagatgtgctgtaagtataaaacaacagattttgaacacggtacaaagaatgtaaaatttctcaatttctaaatattgattacatgttgaaataacattctgaatatattgaataatactttgaatatacagttaatattttgagtataataatatattattaaattgatgtcatctgtttctttttactgttttagatgtggctatagaaagtataaaattacataagtggctcacatacgtcgctcacattatatttttattggatcatcctatgttttccccaaagcccacaggaataatgcctggaacccagaatgctcttcataaatactgggtgaatgcattaagttgggctgcctgagtagagtctaaagactaagaattggcaaactccaatttctccaagcaaagtgtttgctcatttagtaaaaaaatctgagtatctgatagaccttagcagtgggaaagtggtggaaatgtgtgaagctgttgattagcttgaggtgactgttggttcccagctgtatttacactctgcttcaagaaataaacaccatttcacttgggccaactcaaatatttatttctttgacaacaccattttcaaagtgtaagcacttgctttacagtctttttttagggaggcagagccacatgattcttcaaatacttctactcctcacacaatgtggaactttggaattggaccaacccattggcttctgaggagcagccccccatttagaagctgcttgtggctgggcgcggtggctcatgcctgtaatcccagcactttgggaggccaaggcgggaggatcgcttgagctcaggagttcaagactagcctggccaacatggtgaaaccctgtctctactaaaaacacaaaaattagccaggcatggtggcacaagcctgtaatcccactacttgaaggctgaggaaggagaattgcttgaactcaggaggtggaggttgcagtgagccgagatagcgccactgcactccagcctgggacagagcaagactctatctcaaaaaaaaaaaaaaaaaaaaagaagctgcttccttgatatattttgtttcaatttgggaagtgaggacagcaaagggtttaaagggcttaatacactgtagaataggcttgtattctttaacatgttctttaaaaattgccttgatctctgattttctgcaacaagcaagttactccctcccttctacctcaaaatgatgccttggcgtagagtcatcagcaatcctgtcatgacaggccatttaagtggttttgaagccacttgtaaacaattctagtactccattcctggggcagttgaaaaaaaaattaaattcaagaaggtagcttgaaaaagaaaaaaaaatacaacaacttgcctggtagtatattaagaatttttaggccaggtgcggtggctcacgcctataatcccagcagtttgggaggctgaggcgggtggatcaactggggtcaggagttcgagaccagcctggccaatatagtgaaaccccgtctctactacaaatacaaaaattagccaggagtggtggcgggtgcttgtaatctcagctactcaggaggctgaggcaggagaatcacttgaacctgggaggcggaggttgcagtgagccgagatggcgccattgcactccagcctgggtaacaagagcgaaattccatctcgaagaaaaaaaaaaaaaagaaaatttctgatttccaaatatagaatgacttttaagagaaaacactgaattatttagtaagcatccatgaaaacatgcactatgaaatgttctcattcctctatggcccagatacgcatgatctatctcaattttcttctaaaaagtgttgaggcacagttggtggtacactgagctacactgcagcttgttgggttagtgctgatagagacggaataaacaccttgtacagatggtaggattaatacggaggatgttcaatggtccttcccagttgtaatatttagttcttccaggttaaaaagaattgttcaaaaactactgaataaactacttaagatcagccacaaaaatgatttctgtggcttggagaaaaattaggaaagaaaggtaatgtttttagcagtactttaatggtttataagtaaaggtatttaaagctcttataataataataataataataataataaagtttcttggaagacaaagaagtgatggtaaaggaaagattctgcagaacttgtttttttttttctctctcttgacatttggcccaagattagaactttttgctttggtgtaaatgcatgttgtgtacctaacagacacaatgagaggtgatattcttgataaatcttttagattttaaatctcagacatgatgtacatagcaaatcctaaaatatctaaagtgttctccttttaagattcaaaaaacaaaaaacaagaagtagcttaatataggattttcaagagccaggggcaccctctcagtggatagtaaatcccattctgggtccatggtggctgctagtctaactaaagcacagttgggatgaaatcatttattaagaacatataggcggggtgtagtggctcatgccggtaatcccagctcttagggaggctgagggagcacttagggaggccaattagagaggacgacttgagcccaggagttcaagaccaatctggtcaacatggaaaggattggccgggcatggtggcatgcacctgtgttcccagctactcagagggactgaggtgggaggtgggaagatcctttgggcttgggaggtggaggttgcagtgagctgtgattgcagcagacaccctgtctcgaaaaaacaaaagcaggtaatttcagtgtattgtttattacttttttttcctttttactcacccctatactaatgaggaaattatttattactttaacacacttattacatttgcccattaagagggtcatctcagcaaccaatatataacaggaaacaatatttagtgatgtaaagccatgttactgatccaccactcccagaaaacaagagcatcttacctgcagcaaaggcatcagctgcaaacccaatgcttgctcatacagcaagttcagttctgcacaactggagaaggagagtttggaggtgtagaggtaatagtgcacgtgcctaaatgtggaaccatctctgtcgataaatagcctctggctttctgaagaggtcaaggctgaagcctctttccacagcagggagtctggaaactgagagagtttgcttctgggaactgagaaatgccagccccctacgttgaaatgaaacaagtcctctgctgattcatgagccatgccagactcctcctaaagggggaatgaaaaagagatctacgcaagaaaaagaaataaaaaggcatccagattgaaaaggtagaaataaactatctctgtttgctgatgacatgatcttgtatataaaaaatcctaaggaattcaccagaaaactattagaaataagtccaggccaggcatggtggttcacacctgtaatccaagcactttgggagcctgaggtgggaaggtggcttgagaccaggagtttgaggttgcagtgagctatgattgtgccactgtactctggcctaacagagcaagatcctgtctcaaaaaagaaaaacaaacaaaaaaatgagcccaacaaggttgaaagatgcagagcaatatttaaaaatgttgtatttttatacttcagcaatgaacaatctgaaagtgaaattaagaaaacaattcaattccatttacaatagcatcaaaaataacatacttaggaataaatttaacaaaagaatgaaatacatgtgcactggaaacttcaaaacattgttgaaaatttaaaagacctaaataaatgaaaaaatatctcatgctcatggattggaagatttaatatcgttaagatggcaatagtctcccaattgatttacaaattcaacacaatctctgtgaaaatcctgactttttgcaaaaattgaaaaactgatgctaaaattcatatgaaaatacaagggatccagaatagctaaaacagtcttgaaaaaaggagaacgtttaagaagtcacatttcccactttttttttttaaaggcagactgccacatgcagcgcctcattaggatgtgtctgaagtcttggaagcttgactaccctacgttctcctacaacggatcttaagaacttgtttggaggttctagctaggaagagcagatacttgtatacccttgactgaagactggtcctcctttattggggatggtcgtcctctttgactgagcacgcagcttcaggagggacgcacgtggagcgttgagggaagaaggggacacccgcctagacagccagatcagccaaatcaaccctggcaatcaatggagtgacagatgtcacagccagatcaccctcacatcccacacttttaaaacttatttcaaagctagatcaagacagtgtgctaccagcataaggataaatataaagataagtggaatagaattgagagtacagaataaaacccctacacttatgatcaattgaattttgataagcaatccaagatgattcaatggacaaagaatagtccttattaaaaatggtgctgggacaactgcccatccatatgcataaaagataataataacaataataataaagttggacccctacctcaacccatacacaaaaattagctgcaagtgaaacagacctaaaactataaaatctttttttttttttttttgagacggagtctcgctgtatcacccagcctggagtgtagtggtaacaatctcggctcactgcaaactccacctcccgggttcactccattctcctgcctcagcctcctgagtagctgggactacaggcacccgccaccacgcccggctaattttttgtatttttagtagagatggggttttactgtgttagccagcatggtctcgatctcctgacctcgtgatccacctgctttggcctcccaaagtgctgggattacaggcgtgagccactgcacccagcctaaaaccataaaatctttagaagaaaatagaaaatcttcatgactttggagtaggcaaaactttcttagatgtgacactaaaagcaaaagtgaccaaaaaaatagataaatggaacttaatcaaaatttaaaaacatttgtgctttagagggcaccatcaagaaggtgaaaagataactcacagaatggaacaaaatatttgcaaatcatttgtctgataaagaacttgtttttagaatatataaagaactcttaaactcaataacaaaaagacaaccaaatttaaaaattggcaaagcatctaaatagacatctctccaaagaatatatacaaatgaccaacagaacgaaaaaagatgctcaacatccttagtcatcagagaaatgcaaatcaaaacccacaacagaatactacttcacacccattagtatggctacaatgaaaacaataggtaataacaagtgtcgacaaagaaaccagaacccccatgcactgctggtggaggtgtaaaatggtgcaggcactttggaaaacagtttggtgggtcctgaaaatgtaaagcatggagttattctactatgagccagcaattccactcctaggtgtacacttaagacaaataaagacatatgtccacaccaaaatttctagactaatgttcatagaacataatagccaaaaggttggaataaacctaatgtccatcaactgacagatgagtaaacaaaatgtagtatatccacacaatggaatattgtttgtcaatacgaaggaatgggatgaacatggtggcttgtgcttgtaatcccagcactttggaaggctgaggcaggagattcacttgagcccaggagtttgaggctgcagtgagctgtgatcgtgccattgcactccagcctgggcgtcagagtgaggcacgtctctaaaaaaataaaaaataaaaaggaatgaagtactgatacatgataacaacatggatgaaattcgaaacattatgccaagggaaagaagccaaacaaaaaatcacatatgattccatccacatgcaatgtgtggacaaggcaaatttctagagatagaaaatagattagtggttgcctagggctggagaggctatggggagatggggtgtgactactaatgagtatgggatttcttttggggatggtgaaaatgttctaaaattgattgtgatgatagttgcacaactctgaacatactaaaactcactgaattgtacacattaaaatgtgtgaattgtatggtatgtgaattatatctcaatagatctacaaaaaaaaaaaaagatgaggtactgtccattccatggagcgcatgcagaactctcttgggatcttacctgcagagacattacattactggaggatgaatgctatagataccttttcatatatacaaaggcagcaaagatcactaaccttcctcagctcattgttaaaagtttaaggtcatctgtatatctgttggacaagaggttgttgaaaaaaaagtttaaggtcatctgtacatctgttggacaagaggttgttgaaaaaaaagtttaaggtcatctatttataagtgaattgtcttctttgtttcaagatgacctagtttatcaatacgatggaaaagtagagagccatcaaacatacaaaccatccatatcaaattttaaaataaagggcactacccttgtaaaaatattttttaaagggtagtaaatagtatatagaattttacctaaaaagaaccataaaacaatatcgaattctaattaaaaattatgcaggctgaagtgattggactgcaatgtactgatatctgcaatttattttgagatgaatttaaaaaagacagattgatggacagataggattgctagatggacatgtgataaaacaaatatgagcaaaatgttgattgtagaatgcaggtggtggatatatggtgctcactgtacaattctttcaatctttctgtgtttataaaattgcattaagacgttcgtgggggaaaaacagtgttaaagtaagaggtgattacttaagaaaggaaaagctccctgctccagaaagaacctgcatttcccattctgacagctgaggaaggaaaataaatgcatgcaagaaagaatgggatggggtccatctctcccacagcaatattcagacataaagaagagcaattatatatgccacatttgagactagaagagttaaagggggtaataagagaaatatgacaaattgtgaaatgattgcataactgacagaagcagagccagaaaagtcaatctaatgagctaacctagaattctaagtcccagcccttctaaaagcctttctacaagttcatgttcaggcaaaggctgaatgtaacaaatggagtgactaagggtctcacatagaccagaaagcataaatatgcaaggaaggacccttgattctgctttctgttctccttaaaggtggctgagagctcaatgggggtgctcagagtgtgcagatgttggatgccaaagaaaacctacttctcgaaggtgagccccagttctggtctcagttcctcttttctttctttcttttttttctttttttctttttttctttttttttttttttgagacggagtctcgctctctagcccaggctggagtgcagtggcacgattttggctcactgcaagctccacctcccgggtttacgccattctcctgcctcagcctccagcctcctcaagtagctgggactacaggcgcccgccaccacgcccggctttattttattttattttattttattttgttttatttttgtatttttagtagagatggggtttcactgtgttagccaggatggtctcgatctcctgacctcgtgatccacatgcttcggcctcccaaagtgctgggattacagacgtgagccaccacgcccagcccaccctcttttcttgttaaggatagggtgtgacaagagggtcctggctccttcttacatacatgtcccatccacaggtgggctcttaagtgcctgctggagtgagggtaggggttagggatgcggctgttctttcccaaagactactcaggggctggttagtgcagagctatcgcagcctggcgacagccctcagtcacaggcaagcttaggggaacctgtggtgcttgaaagacaaaaggcttcttgccggactgacttcaggaaacggggtagccctaaagcagtcatccccaccccattacaaagagcttctctctttcccacgctgatccttctcccccgaagaagctccgtccaagtaaatttcttaccttttttttttttttttttttgagacaaggtctggctctgtcactcaggtcgcccaggctggagtgcagtggtgcaatctcggttcactgcaacctccacctcccgggttcaagcgattctcctgcctcagcctcccgagtagctgggactacaggccgtgccaccacacccggctaatttttgtatttttagtagagatggggtttcaccatgttggccaggctggtcttgaactcttgacctcaggtgatccgcccacctcgggctcccaaagtgctgggattacaggcgtgagacaccgcgcccagcccgtccaagtcaatttctagagctagaacttcctcatgctctaaagacaggaccccaactcctcagagccaggattcccaacctttcagatctggagctccccatcatgccttagagttctgtccccacgctccaatccttcagatttggatctccccttcacacacaccctcgccttgccccaaagtcagcatcccccagcgctgagatatgaagaccaccccgtcaaaggggcacacgcccagccctcagaaccggagtcccccacatcctcagagccagaacacttcatccctcaagacagagcgttattctaactcctcagagccagccccccaaatccttcccggctgggggcccctcgctctctcccatgccccagagccaggtctcgaaccacttagccccaatccttggccacagcggcccccattcgccgctttggtgcttttggcgcccccgccagagcgggctccgtaccatggtcgcggctccagcagcgggcgggcgggcttgtgacccggccaataacggttcccggggtcgcggcggcgcgcgcgcggggggcggggcagtgggcggggcctggcgtgcgccgggtggtctcgcgggcggtggcaggtgagcggcgggcggggatggcggagcaatgggagctggacgaggaaggcattcgccgcctgggggcgctgacgctggagcagccgggtagggtctggccgggagggtgtggactgggaacgtagggtcagaagctgtggaaagaaaactgaagtggaaggcggggaacctgagatagaggcgagggaaccacagagaagcggtacctgaggctggggggcggggggataacttgaggcagaaggttagagggaggtggaggtggaggaactgaagtaacgggagggtgtggggcagagcccgaggaattgagagagaagaggggagtgtgaagtagggaaggagaaacaaggttaacaggggaccctgccgcaggtgacagaactgcggggggcggtggctgaccgctgtaatcccagcactttgggaggcggaggcgggtggatcacctgagcgtggccaacatggtgaaaccccgtctctactaaaatacaaaaattagcccggcgtggtggttcaagtctataatcccagctactcgggaggctgaggcaggagaatcgcttgaacccgggaggcggaggttgcagttagccgagatcgcaccactgcactgcagcctgggcgacagagcgagactccatctcaaaaataataataataaataaaataaataaataataaaatgtctattagacatccaagtgtaaggtacctagtaggcagttggatatatgggtctggacctcagaggagaggtcagggttagagatgaaaattttggagacattagcaataggtggtatttaaagctacgggagtggatgaactcagctaaggagagaatgtcgatggagaagtgaaagaaagcttaagactcaaccttggaatatttcagtgtttagaggttgtatagaggaagaatgtggtatcttggaatttgagaaggggtagtgtatcgagcaagcaatggccaactgtgccaaatgctattgacaggctgagcaacttaaatgcagagtgtctgttagatttagcaacatggaacttactggtgaccttgacagagggagttttgggagggtggggaggagggaaaccagattggagtgggatgaaaaagggaaatgatatttgaggggaagagacagtgaaagtaagaacttttgctgaaaattttagctgtaaaagagactgcagaaatagatggtagctgaagcgtatgatgtgcagtcaagaacagaacaggaaggatatactagagcatgtcggtagtctaatgattaatttggtagaggggggaaatatgtaatatttactcattttgactgttaaaataattcaattaatttattctgtgggtaatataataattgtacagtgagggccaggcgcggtggctcacgactgtaatcccagcactctgggaggccgaggcgggcggatcacgagtcaggagatcgagaccatcctggctaacacagtgaaaccccgtctctactaaaaatacaaaaaaaattagcggagcatggtggcgggcgcctgtagtcccagctactcgggaggctgaggcaggagaatggcgtgaacccaggaggcggagcttgcagtgagccgagatcgcgccactgcactccagcctgggtgacagagtgagactccgtctcgaaaaaataaataaataaaataaaaattgtacagtgagaagaaagtctttactcccccatccccgtctcataggcctagttccccttcctaaaggcaattactgttaccagtatcttggatagttttccagaaatattctctacatatataagcatttatcacttattttataattttatattatggcaattttcaaatatatacaagagtagagataacagaataatgaactctattagcctacctcaacagttatcatcaattcatggccaagcttctttcacgtatacctcacctatcctccacccacctccaaccccctacactgactattttgaagcaaattccaagtatgtgatttcctccataaatatttcagtagtattttatttatttattgtttttattatttttcagatagagttttgctctgtcacccaggctctagggcagtggcgtgatctcggctcactgtaatctccacctccgcatttcaagcgattcttctgcctcagcctcccaagtagctgggactacaggcacccgccaccacgcccggctaattttgtattttcagtagtgacagggttttgccatgttggccaagctggtcttgaactcctgacctcaagtgatccacccacctcagcctccctaagagttgggattataagtgcaagccacagcacctggccagtatgtatttttaaaagctaagattactttaaaaaaaagtcacatatgcaacctaaaaaatttaacagtaatttctttttttggttttgttttgtttttgagatggagtctggctctgttgcccaggctggagtgcagtggcatgatctcagctcactgcaacctctgcctccagggttcaagcaattctcctgcctcagcttcctgagtagctgggatttcaggcatgtgccaccatgcctggctaatttttttgtatttttagtagagacggggtttcaccatgctagccaggctagtcttgaactcctgacctcaagtgactcagcctcctaaagtgaacagtgatttcttgatatcatgaaatatctaactagtgttcttatttccccagttgtcctataattttttaaaattagaatccatggccgggtgcgttggctcatgcctgtaatcccagcactttgggaggccaaggtgggtggatcacttgaggccaggagttcaagaccagccaggccaacatggtgaaaccccatctctattaaaaatacaaaaattagctggacatggtggctcacacctgtaatcccaactacttgggaggctgaggcaggagaatcgcttgaacccgggagacggaggttgtagtgagctgagatcgcgtcactgcactccagcttgggtggcagagcaagtctccatctaaaaaataaaataaaataagaatccgtatatggtccatatattgcaattggttgatgtatgtcttaagtcttatttgatctgtaggctccccattttttttccctcgcattttcaattgtttttgaagaaactggctttgaaagagtttactataacctgaactttgctcattgcattcctaagatgttaaacattttcccgtgttccctgtacttcctatgaattggtagttagatgaggcttaatcagattcaggttggattttttttttttcacaagacgatttcataggtaatggtgtatgtttatgttaggaagtatatggtgcctagtgttctttcttttcgtgatatcagccactgaatatgattacctaagttaattcattagggattgcaaaatggtaattgtctatttctttcatttttcttcattaactgtaatacttctataaagagaaatttcctcacatcaactgtttgcttatcctgaggtacagtttgtataggaaaggcagcataaaagcttgatttgttttcaccttatatgccagctttcagaatgatgagttattttcttagcattctccaaaggtgaccagtgaggactgttttgctttctcagtatcattataaactcatcgatttaaatatatgtcttagggctgggcatggtcgttcacgcctgtaatcccagcattttgggaggccaaggaggatggatcacctgaggtcaggagttcaagaccagtctgtccaacatggtgaaacctcatctgtactaaaaatacaaaaaaaattagcccggcatggtggcaggtgcctataatcccagctactcaggaggctgaggcaggagaatcacttgagcctgggaagcagaggttgcagtgaactgagatcgcaccactgcacttcagcctggacgaaagactgagactcagtctaaataaataaataaataaataaatgtcttagtcccttttctcttgtcataacagaataccatagactaggtaatttataaagaacagaagttgatttggctcatggttctggaggctgagaagtccaagagcatggtgccaacatctggtgagggtcattccatggtggaagggcagaaggtgcatgtgtgagatgtgagagagaaagagagagagagagagagagagagagagagagagagagagagagaagactgaactaattcctttattaggatagctaactcccgtgataactaactccatgataacagcatgaagccaccgttgacctaatcacctcttagaggccccacctcgcagtgctgttacattggcaattacgtttcaacatgaaagctgggcatggcggcttacacactttggaaggccagggaggaggatgaggccaggtatttgagaccagcctgggcaacacagcaagatcctgtctctacaaaaaatttaaaaattaactgggtgttggtggtgtgtacctgtagtcccagctactcaggaggctgaagtggaaggatcctctgaccccaggagttttaggctgcagtgcactatgatagtgctactgccctccagcctagttgacagagcaaggccctatctctgaataaattaatacatttcatcatgagttttggaggggacgttcaaaccatagcaatatatttcaatgtaagttttaatccattatagttcttatcataattgatgttcagtttatcctaactttagttaataggtgatctttcaagttgactcctgaggtctttttaaaaaagttttatggccaggtgtagtggctcacgcctgtaatcccagcactttgggaagccgaggggggtggatcacctgaggttgggagtttgagaccagcctggccagcatgttgaaaccccatctctactaaaaatataaaaattagctgggcggggtggcacatgcctgtaatcccagctacttgggaggctgaggcaggagaatcgcttgaaccctgaaggcggaggttgcagtaagccaagatcacaccattgcactccagcctgggcaaagagagcgaaactccatctcaaaaaaaaaaagaaaaagaaaaagttttatttattagaaacattcattgtcattataaataagctttgttaaaggttgttaattcaatttccaaatgagctgtaaatggttttcattagagagactacttgatttgttattttcaaatagcaaatttttgcccactggggttatgtaacccatatattaaaattggaagatcattcttttattcttggcatctatgctgtgcagtgtttgatttgttctctgatttgtcttcactctttataaacactgaaacggccaggcgcggtggcttacgcctgtaatcccagcactttgggaggctgaggagggcgaatcacgaggtcaggagatcgagacaaccctggctaacatgatgaaaccctgtctctactaaaaatacaaaaaaattagctgggcatggtggtgggcgcctgtagtcctagctacttgggaggctgagacaggagaatggcgtgaacctgggaggcagagcttgcagtgtgccaagatggtgccattgcactccagcctgggtgacagagcgagactccgtctcaaaaaaaaataataaataaataaataaacactgaaacgaaatgcataacctcttaagacatgcattcatgtgaatcattaaagaatgtttgtctttgtggcagtttatcattttaataattcacattccttcttaaaatgttaaaatgtctgctcttcaaaatagactgcagtgaaaggcatgagaaatgctgtgggtcattgatggaaaccataattgtccttagcttttgtcccatgttaacagactctcagggtgttagatcataacataccacagaattaccaatacactgccctcaaagtcaggaaaattttatttatttatttattttatttatttatttttttttaaaaaaaacatggtcttattctgttgcccaagctggagtgcagtggcatgatcatggctcactgcagtcccgacctcctgggctcaagcaatcctcctgactctgcctactgagtagctgggactacaggtgtgcaccaccatgcccagctaattttttctttttttgtagagatgggtgcattttaaaaagatataattcacatactataaagttcaccgttttagtatttatttatttattttgagataagaatcttgccctattgcccaggctgcagtgcagtggcccgacctcagctcactgcaacctctatcccaggttcaagtgattctcctgcctcagcatcctgagtaggtgggactgcaggcacgtcccaccataccctgctaatttttgtgtttttagtagagacagggtttcaccatgttggccaggctggtcttgaactcctgacttcaagtgatccacctgcctccgcctcccaaagtgctgaaattacaggcatgagccaccacacgtagccccatttaaaaaatatacaattcagggtcattttgtacatttacaatgttgtgcaagcatcattgctacctatatatagttccagaacattttcatcaacccattaggcagtcacacctcatttcccactacccctggctcctggcaaccagtaaactgctttctgtctctgtggatttgcctcttctgggtatttcatatcattggaatcatataatatgtagccttttctgtctggcttctttgacttagcatagtattttcattattcattcatgttttagcatgtattaatacttcattccttttttaaaaaaattaatagactttattttttagagcagttttaggtttacagagaaattgggcataaagtacagagagttctcatatacgcttaccttccttgcacctctccccacccaccccgtttcccttaattttaatatcttgcattattgtgatatattacaatttatgaaccaatattgatgcgattattaactaaagtccatagtttacattagagctcattttttgtgttgtacagttctatggtttttgacaattatgtcgtgtccaccattattattattatttttatttatttatttttttgagatggagtctcactctgttgcccaggctggagtgcagtggcgtggatctcggctcaccgcaagctctgtctcccagattcacaccattctcctgcctcagcctcccgagtagctgggactacaggtgcctgccactgtgcccggctaatttttcatatttttagtagagaccgggtttcaccatggtctcgatctcctgacctcgtgatccgcccgcctcggcttcccaaagtgctgggattacaggcgtgagccaccgcgcctggccgtccaccattattttttattttttgaggcagagtcttgttctgttgcccaggctggaatgcagtggcacgatctcggctcacagcaacctccgcctcctgggttcaagtgattctcatgcctcagcctcccaagtagctgggactgcaggcgtgtgccaccatgcctggctgatttttgtatttttagtagagacggggtttcaccatgttggccaggctggtctcgaactcccaacctcaggtgatctgcctgccccaacctcccaaagtgctgggattacaggcatgagccagcgtgcctggccagtcgtgtccaccattataataacagttttactaacctaaaaatcccctgtgccccaccatctgtttatccctccctcaccccaaacccctgacaactatcaggtgaaattcacccccgatatttcacgtaggctcttttctattttccctaagtgtcggccggcctgagaaataaagggacagagtacaaaagagagaaattttaaagctgggtgtctgggggagacatcacatgtcagcaggttccgtgatgccccctgagccataaaaccagcaagtttttattagtgattttcaaaaggggagggagtgtacgaatagggggtgggtcacatagatcacatgcttcacaaggtaataagatatcacaaggtaaatggaggcagggcgagatcacaggaccacaggaccggggtgaaattaaaattgctaatgaagtttcaggcacgcattgtcattgataacatcttatcaggaaacaggatttgagagcagacaactggtctgaccaaaatttattaggtgggaatttcctcgtcctaataagcctgggagcactacgggagaccggggcttatttcatcctacagctgtgaccataaaagacatctgcccccaaagcagccattttagaggcctcccttcagggatgcattctctttctcagggatgttccttgctgagaaaaagaattcagcgatatttctcctgtttgcttttgaaagaagagaaatatggctctgttccacctggctcaccggcaatcagagtttaaaggttatctctcttgttccctgaacattgctgttatcctgttcttttttcaaggtgcccagatttcatattgttcaaacacacatgctctacaaacaatttgtgcagttaatgcaatcatcacagggtcctgaggcaacatacatcctcctcagtttacgaagatgacggaattaagagattaaagtaaagacaggcataggaaatcacaagagtattgattggggaagtgataagtgtccatgaaaccttcacaatttatgttcttctgccatggcttcagctggtccctctgtttggggtccctgacttcccgcaacagacaaccactgatctttttttttttttttgagacagactttcgctgttgttgcccaggctggaatgcagtggcacgatcttggctcacggcagcctccacctcccgggttcaagcgattctcctgcctcagcctcccgagtagctgggattacgggcatgtgccactacgcccagctaattttgtatttttagtagagacagggtttctccaggttggtcaggctggtctcaaacccccagcctcaggtgatccgcccgtctcggtctcccaaagtgttgggattacaggcgtgagccaccgcacccggcccaaccactggtctttttattgttgcctttttcagaatgtcatatagttggaatcatatagtatgtaacctttcaaactgatttctctcacttagcaatatgtatttaaggctcctccatgtctttccgtggttaatagcccatttctttttattgctgaatagtattacactctgtggatgtaccattgtttgcttatccatttacctattgaaggacatcttggttgctcccaagttttggtaattatgaagaaagctgctgtaaacattcatgtgcaggtttgggtgtggacataaagtttcaacttgcttgagtaaataccaagggatttacttgtgtttagctttgcaagaaactgccaagttgtcttctcaggtggcttcaccattttgtattcccacccccaatgaatgagagttccttttgccccacatcctcaccaacatttagcattgtgaaagttttaagatttgggccattctaacaaatttatagtggtatctcattttaatttgtaatttcctaacgatttatgatgttgaccatttttttcatatgtttgtttagtggagtgtctggtttggggtttatttttattgctttttagagacaggttcttgctatgttgcccaggctggacttgaacttctggactcaagcaatcctgtctcagcctccccagtaactgagactacaggtatgtgccactgcatccagtttttcttttgcctactttttttttttttatggaaatagggtaatcttactttgttgcctaggttggagtgcagtggtgccatcatgactcactgtagcctg

SEQ ID NO: 7 - DNA, 166804 bp, Homo sapiens
tcctaaatagctgggattacagttgcctgccaccacgcctggctaatttttgtagttttagtagagatggggtttcactatcttggccaagttggtctcaatctcctgacctcaagtgatccacctgcctcagcctcccagagttgggattacaggcgcgagccaccgtccccagccaaggccaaatcttaaaaggggagaaatccaagaagaggaaacggcaagtgaaaaagtgtagagagaaagcatgtggggtgcttggggcaaggctgaacttcaaagtgtgtgtgtgtgcctgtgtgtgtgtgtgtgcatgtgtatgtggccttgcctgcatgtaggtgtgtgtctttgttgggatatgagccagcacaagcagatgagccagcctgtgaggagccctgatgccacgtcaaggggtttgcatttgagtcatccacttacccacaccacagacaagctacacagttgggatgaatatctgctgtttatgtcatcctcttcctttccaagatcacagtcataatctcacatcatgagtaatgggaaatgtgagactgccactggtctattttcttaaaaacgtcatttgtgtgatcaacataaaaactccctggctcccttgagcacaaggaatgaaggcgtgtttgggttgcttgctggtagcagaatgctcacaagtggaacaatttaaagttccaaactgagaagtccccagaaggtgtgaaaaaggaaacataagtagcatgtcctgtcaacacattgtcctcagtggacttcaggggggaagtaaaaaagaatcgataatttgccatgaaacttaaaccctggtgaatgaccctaaagggaaattccacactctgcagctgtgactcccacccaggctgatggatgtgaagggctcagatcagtttacatttaggtaaggtggccttcccaaattacacaggaagttctaggaggccctgtgatattaatgtgtggacctgtaatgactactttgtatttcccctataaacaatatacagtattccaaaatatccagattcatggatttacatatcagcttttatgactcccaaatttttatctctaggcctaactgtttccatgaattccagacctgtacatcccgcgcctcctgtttaccttcacttggatggttttattgccctttcattgtctctcaaactcaacatgttcagatcctaactcctgattttcctccctaaacctgtgtacacatccctcaaaatccaccattcatctggttgctcaggagagaaacaaaggagttgtccattctctctcaccctacattcaattcatcagcaaaccctgtcagttctaccagcaagacatattcagagtttgaacacctctaacactactattaccaccatagaacaaaccaccattatctttcatctggatactgcaggagcctcttaactggtctgtctacttcctcccttgctctgctgcagtctaggccaggggtcagcaagtttttttctataaaaggcctgacagtaaatattttaggctttgctttgctagccacatggtctctgtcaactcaaccactcagctctgtgttacagcttgagagcagccatagacaacacataaacaaatgagcatagctgtgttccagtaaaactttatcaatggcactgaaattagaattttttttttttttttgagacagagtctccctcagtcgcccaggctggagtgcagtggtgcgatctcagctcactgcaaccaccgtctcctaggttcaagcgattctctcatctcagcctccccgagtagctgggattacaggcacttgtcatcatgcccggctaatttttgtattttagtagagatggggtttcaccatgttggccaggctggtcttgaactcctgacctcaggtgatctgcccgccttggcctcccaaagtgttaggattacaggcgtgagccaccacgcctggcctgaaatttgtatttcatatgatttttacatagcacaaaatatttttgattttttttcaaccatctaaaaatgtaaaacccattcttagctcatgggctttccaaaaaaggtagtggctgaatttcgtccatgggctgtagtttgcagattcttgatctaaggttaagccagcagccaatgatctttctttttatttggggatagagtcttgctctgctgcccaggctggagtgcagtggcatgatcttgactcactgcaacctccgcctcccgggttcaagcaattctcctgccttagcctcctgagtagctgggattacaggcgcatgccaccatgctcagctaattttgtatttttagtagagatggggtttcaccatgttggtcaggctggccgcctcagcctcccaaagtgctgggattacaggcatgagccactgcacccggcctttttttttttttttaaagagaagatcttgctgtgtcacccaggctgggatgcagtggtgaaatctcggctcactacagccttgaactcctgggctcatatgatcctctggcttcagccttctgagtagctgagactacaggcacatgctaccatgcctggataatttttaaattttttgtagagatgatgtctcattatgttgcccaggctggtatccaactcctggcctcaggtgatcttcccacctcagcatcccaaagtgttgagattacaggtgtgagccaccgtgcccagcccctctctccctccctccctcctccccttctttcttccttccttcttcccttccttcctttcttctctctctccctccctccctccttccccctctcttcccttcccttccttcctttctttcttttcctgagatatatttcacatactataaaacttacccatttaaagcatgcaattcagtggcttttaatctattaacagaatcaagcaaccatcaccacaatctacttcaatacccctaaaagaaaccctgtacccaataacagtcactgctcattctccattctcactcacccatccttcctaccctgagccccagccctaggaagccacttatctatcttctgtctctataaatttgcctgttctgcacattttagataaatagaatcatacaatatatggtgccattttatttatttatttgtttgtttgtttgttatagagatggggctttgtcatgttgcccaggctggtcttgaactcctaagctcaagggatccacccacctcggcctcccaaagtgctgggattataggcatgagccaccgcacccagctgtgtctatcttctatacatataatcatacaataagactgtttctttcacttagctgacatgatggtttttttcacttagcattatatatatatatatatatatatatatatatagagagagagagagagagagagagagagagagagagagagagaggggaagggtcttgctttgtcacccaggctggaacacagtggtgcaaacacagttcattgcagccttgacctccctggctcaggcgatcctcctgccttagcctcccaagtagttgggactataggcatgagccatcatgcctagctaaatttcttttttaattttttgtagagttggagtctcactttgttgcctaggctggtctcgaacttctggcttcaagcaatcctcctgcctcagcctccaagagctacctataacatttagaataaatcctgtgtcttcaccatggctttcaaggttctgcaagatctggcttcctctgatctcattgtcaacctttgacatctccctacctctcactgtactttacaatggcctccaagtgggccaacgagccactataacctcagggtattagcgtttaactattcctcttttttttttttttgggatagtctcactctgttgcccaggctggagtgccgtggctcaatctcagctccctgcaacctccacatcctggattcaagcgacactcctgcctcagcctccacagcagctaggattacaggcatgagccaccatgcccagctaatttttgtgtttttttgtttgtttttttgagacagagtcttgctctgttgcccaggctggagcacagtggcacgatctctgctcactgtaacctccgcctcccgggttcaagcaattcttctgcctcagcctcccaagtagctgggattataggcgcacgacaccatgcccggctaatttttatatttttagttgagatgggatttcaccatgttgtccaggctggtctcaaactcccgacctcgtgatcgcctgcctcggcctcccaaagtgctgggattacaggtgtgagccaccgtgcctggctaatttttttgttttttagcagagatggggtttctctatgttggccaggctggtctccaaccctgacctcaagtgatccacccacctcggactcccaaagtgctgggattataggtgtgagccaccgcgtctggcctaactattactaatgtctgtaagttctttccccagatacctgcatgccttacccctttgcccctttttcattcagatttctgctcaaatgttgccttgtcaatgaggcctgtttgatcactgttttcttatttatttaagtatttattgacaaggtctagctctgtcaccctggccgaagtgcagtggtgcaaatatggctcactgtggcctcaaactcctgggctcaagcaatcctcccacctcagtctcctgagtagctgggaccacaggcatgcaccatcatgtctggctaattaaaaaaatttttttgtagagacagcttttgccatgttgcccaggctggtcttgtcctgggctcaagaatcctcctgccttgacctcccaaagtgttgtgattgcaggtgtgagacaccatgcccagcctctgatcactcaatacagaagtcacttccctggctccagtcacttgctatcccccttacccttcttgccacatactatccatctgaatattaaaagacaagcagattcgatgtaaatgttttattctttcaactaaattctagtactagaaggacagtaaaacaatgatatgctggggaaaatgtagcaatatacttttgtttaaaagactgattgaataaacaaaaactacaaaaaaaaagaaaataatataaacataatctgaaattccaagaagtcctggaatacagaaatgccctcctccttcattattacacaggaagcactgttttaattgtcttcatagcatttatctctacctgacattgtatagctacagggttcactcctgtatctccagaacttggtgtaagtttggtgcttaatacacaataagacactaataagcatcaagtgtatcctttggaggccacaactacaggctagaggtgggggttgggtgggcaggtggagttgggggatttggggaatggggaggggtggagagcagagcagcagcgtgagcctgggtgcctgtactccagaagcttcccatcttgtgctgcttgttgatcattctacatggctttccatcaaagcctactatgtcacagataattctgagtagaatatgcatttgttgagtgcatgggaaccttagttagcaggaggcaaagtcacatttttattgttaggggctgaatctgaaggactctatggtgaggagtactaacagtttagagcagtttagatatatgctgcccaatatggtagccactagccacgtatggttattgactacttgaaatgtgacagtctgagacccagcacggtggctcacatctgtaatcccagcaatttgggaggctgaggggcagattgcttgaggccaggagtttgagacaagcctggccaacataacaaaaccccatctccactaaaaatataaaaattagctgggcgtggtgctgcacacctgtaatcctagctacttgggaggctgaggcatgagaagctcttgaaccagaaaacggaggttgccatgagccgagatagcaccactgcactctcacctgggcgacagagtgagactctgtctccaaaagaaaaaaaaaaaagaaagaaatgtgacagtctgaatctgagatgtgctgtaagtataaaacaacagattttgaacacggtacaaagaatgtaaaatttctcaatttctaaatattgattacatgttgaaataacattctgaatatattgaataatactttgaatatacagttaatattttgagtataataatatattattaaattgatgtcatctgtttctttttactgttttagatgtggctatagaaagtataaaattacataagtggctcacatacgtcgctcacattatatttttattggatcatcctatgttttccccaaagcccacaggaataatgcctggaacccagaatgctcttcataaatactgggtgaatgcattaagttgggctgcctgagtagagtctaaagactaagaattggcaaactccaatttctccaagcaaagtgtttgctcatttagtaaaaaaatctgagtatctgatagaccttagcagtgggaaagtggtggaaatgtgtgaagctgttgattagcttgaggtgactgttggttcccagctgtatttacactctgcttcaagaaataaacaccatttcacttgggccaactcaaatatttatttctttgacaacaccattttcaaagtgtaagcacttgctttacagtctttttttagggaggcagagccacatgattcttcaaatacttctactcctcacacaatgtggaactttggaattggaccaacccattggcttctgaggagcagccccccatttagaagctgcttgtggctgggcgcggtggctcatgcctgtaatcccagcactttgggaggccaaggcgggaggatcgcttgagctcaggagttcaagactagcctggccaacatggtgaaaccctgtctctactaaaaacacaaaaattagccaggcatggtggcacaagcctgtaatcccactacttgaaggctgaggaaggagaattgcttgaactcaggaggtggaggttgcagtgagccgagatagcgccactgcactccagcctgggacagagcaagactctatctcaaaaaaaaaaaaaaaaaaaaagaagctgcttccttgatatattttgtttcaatttgggaagtgaggacagcaaagggtttaaagggcttaatacactgtagaataggcttgtattctttaacatgttctttaaaaattgccttgatctctgattttctgcaacaagcaagttactccctcccttctacctcaaaatgatgccttggcgtagagtcatcagcaatcctgtcatgacaggccatttaagtggttttgaagccacttgtaaacaattctagtactccattcctggggcagttgaaaaaaaaattaaattcaagaaggtagcttgaaaaagaaaaaaaaatacaacaacttgcctggtagtatattaagaatttttaggccaggtgcggtggctcacgcctataatcccagcagtttgggaggctgaggcgggtggatcaactggggtcaggagttcgagaccagcctggccaatatagtgaaaccccgtctctactacaaatacaaaaattagccaggagtggtggcgggtgcttgtaatctcagctactcaggaggctgaggcaggagaatcacttgaacctgggaggcggaggttgcagtgagccgagatggcgccattgcactccagcctgggtaacaagagcgaaattccatctcgaagaaaaaaaaaaaaaagaaaatttctgatttccaaatatagaatgacttttaagagaaaacactgaattatttagtaagcatccatgaaaacatgcactatgaaatgttctcattcctctatggcccagatacgcatgatctatctcaattttcttctaaaaagtgttgaggcacagttggtggtacactgagctacactgcagcttgttgggttagtgctgatagagacggaataaacaccttgtacagatggtaggattaatacggaggatgttcaatggtccttcccagttgtaatatttagttcttccaggttaaaaagaattgttcaaaaactactgaataaactacttaagatcagccacaaaaatgatttctgtggcttggagaaaaattaggaaagaaaggtaatgtttttagcagtactttaatggtttataagtaaaggtatttaaagctcttataataataataataataataataataaagtttcttggaagacaaagaagtgatggtaaaggaaagattctgcagaacttgtttttttttttctctctcttgacatttggcccaagattagaactttttgctttggtgtaaatgcatgttgtgtacctaacagacacaatgagaggtgatattcttgataaatcttttagattttaaatctcagacatgatgtacatagcaaatcctaaaatatctaaagtgttctccttttaagattcaaaaaacaaaaaacaagaagtagcttaatataggattttcaagagccaggggcaccctctcagtggatagtaaatcccattctgggtccatggtggctgctagtctaactaaagcacagttgggatgaaatcatttattaagaacatataggcggggtgtagtggctcatgccggtaatcccagctcttagggaggctgagggagcacttagggaggccaattagagaggacgacttgagcccaggagttcaagaccaatctggtcaacatggaaaggattggccgggcatggtggcatgcacctgtgttcccagctactcagagggactgaggtgggaggtgggaagatcctttgggcttgggaggtggaggttgcagtgagctgtgattgcagcagacaccctgtctcgaaaaaacaaaagcaggtaatttcagtgtattgtttattacttttttttcctttttactcacccctatactaatgaggaaattatttattactttaacacacttattacatttgcccattaagagggtcatctcagcaaccaatatataacaggaaacaatatttagtgatgtaaagccatgttactgatccaccactcccagaaaacaagagcatcttacctgcagcaaaggcatcagctgcaaacccaatgcttgctcatacagcaagttcagttctgcacaactggagaaggagagtttggaggtgtagaggtaatagtgcacgtgcctaaatgtggaaccatctctgtcgataaatagcctctggctttctgaagaggtcaaggctgaagcctctttccacagcagggagtctggaaactgagagagtttgcttctgggaactgagaaatgccagccccctacgttgaaatgaaacaagtcctctgctgattcatgagccatgccagactcctcctaaagggggaatgaaaaagagatctacgcaagaaaaagaaataaaaaggcatccagattgaaaaggtagaaataaactatctctgtttgctgatgacatgatcttgtatataaaaaatcctaaggaattcaccagaaaactattagaaataagtccaggccaggcatggtggttcacacctgtaatccaagcactttgggagcctgaggtgggaaggtggcttgagaccaggagtttgaggttgcagtgagctatgattgtgccactgtactctggcctaacagagcaagatcctgtctcaaaaaagaaaaacaaacaaaaaaatgagcccaacaaggttgaaagatgcagagcaatatttaaaaatgttgtatttttatacttcagcaatgaacaatctgaaagtgaaattaagaaaacaattcaattccatttacaatagcatcaaaaataacatacttaggaataaatttaacaaaagaatgaaatacatgtgcactggaaacttcaaaacattgttgaaaatttaaaagacctaaataaatgaaaaaatatctcatgctcatggattggaagatttaatatcgttaagatggcaatagtctcccaattgatttacaaattcaacacaatctctgtgaaaatcctgactttttgcaaaaattgaaaaactgatgctaaaattcatatgaaaatacaagggatccagaatagctaaaacagtcttgaaaaaaggagaacgtttaagaagtcacatttcccactttttttttttaaaggcagactgccacatgcagcgcctcattaggatgtgtctgaagtcttggaagcttgactaccctacgttctcctacaacggatcttaagaacttgtttggaggttctagctaggaagagcagatacttgtatacccttgactgaagactggtcctcctttattggggatggtcgtcctctttgactgagcacgcagcttcaggagggacgcacgtggagcgttgagggaagaaggggacacccgcctagacagccagatcagccaaatcaaccctggcaatcaatggagtgacagatgtcacagccagatcaccctcacatcccacacttttaaaacttatttcaaagctagatcaagacagtgtgctaccagcataaggataaatataaagataagtggaatagaattgagagtacagaataaaacccctacacttatgatcaattgaattttgataagcaatccaagatgattcaatggacaaagaatagtccttattaaaaatggtgctgggacaactgcccatccatatgcataaaagataataataacaataataataaagttggacccctacctcaacccatacacaaaaattagctgcaagtgaaacagacctaaaactataaaatctttttttttttttttttgagacggagtctcgctgtatcacccagcctggagtgtagtggtaacaatctcggctcactgcaaactccacctcccgggttcactccattctcctgcctcagcctcctgagtagctgggactacaggcacccgccaccacgcccggctaattttttgtatttttagtagagatggggttttactgtgttagccagcatggtctcgatctcctgacctcgtgatccacctgctttggcctcccaaagtgctgggattacaggcgtgagccactgcacccagcctaaaaccataaaatctttagaagaaaatagaaaatcttcatgactttggagtaggcaaaactttcttagatgtgacactaaaagcaaaagtgaccaaaaaaatagataaatggaacttaatcaaaatttaaaaacatttgtgctttagagggcaccatcaagaaggtgaaaagataactcacagaatggaacaaaatatttgcaaatcatttgtctgataaagaacttgtttttagaatatataaagaactcttaaactcaataacaaaaagacaaccaaatttaaaaattggcaaagcatctaaatagacatctctccaaagaatatatacaaatgaccaacagaacgaaaaaagatgctcaacatccttagtcatcagagaaatgcaaatcaaaacccacaacagaatactacttcacacccattagtatggctacaatgaaaacaataggtaataacaagtgtcgacaaagaaaccagaacccccatgcactgctggtggaggtgtaaaatggtgcaggcactttggaaaacagtttggtgggtcctgaaaatgtaaagcatggagttattctactatgagccagcaattccactcctaggtgtacacttaagacaaataaagacatatgtccacaccaaaatttctagactaatgttcatagaacataatagccaaaaggttggaataaacctaatgtccatcaactgacagatgagtaaacaaaatgtagtatatccacacaatggaatattgtttgtcaatacgaaggaatgggatgaacatggtggcttgtgcttgtaatcccagcactttggaaggctgaggcaggagattcacttgagcccaggagtttgaggctgcagtgagctgtgatcgtgccattgcactccagcctgggcgtcagagtgaggcacgtctctaaaaaaataaaaaataaaaaggaatgaagtactgatacatgataacaacatggatgaaattcgaaacattatgccaagggaaagaagccaaacaaaaaatcacatatgattccatccacatgcaatgtgtggacaaggcaaatttctagagatagaaaatagattagtggttgcctagggctggagaggctatggggagatggggtgtgactactaatgagtatgggatttcttttggggatggtgaaaatgttctaaaattgattgtgatgatagttgcacaactctgaacatactaaaactcactgaattgtacacattaaaatgtgtgaattgtatggtatgtgaattatatctcaatagatctacaaaaaaaaaaaaagatgaggtactgtccattccatggagcgcatgcagaactctcttgggatcttacctgcagagacattacattactggaggatgaatgctatagataccttttcatatatacaaaggcagcaaagatcactaaccttcctcagctcattgttaaaagtttaaggtcatctgtatatctgttggacaagaggttgttgaaaaaaaagtttaaggtcatctgtacatctgttggacaagaggttgttgaaaaaaaagtttaaggtcatctatttataagtgaattgtcttctttgtttcaagatgacctagtttatcaatacgatggaaaagtagagagccatcaaacatacaaaccatccatatcaaattttaaaataaagggcactacccttgtaaaaatattttttaaagggtagtaaatagtatatagaattttacctaaaaagaaccataaaacaatatcgaattctaattaaaaattatgcaggctgaagtgattggactgcaatgtactgatatctgcaatttattttgagatgaatttaaaaaagacagattgatggacagataggattgctagatggacatgtgataaaacaaatatgagcaaaatgttgattgtagaatgcaggtggtggatatatggtgctcactgtacaattctttcaatctttctgtgtttataaaattgcattaagacgttcgtgggggaaaaacagtgttaaagtaagaggtgattacttaagaaaggaaaagctccctgctccagaaagaacctgcatttcccattctgacagctgaggaaggaaaataaatgcatgcaagaaagaatgggatggggtccatctctcccacagcaatattcagacataaagaagagcaattatatatgccacatttgagactagaagagttaaagggggtaataagagaaatatgacaaattgtgaaatgattgcataactgacagaagcagagccagaaaagtcaatctaatgagctaacctagaattctaagtcccagcccttctaaaagcctttctacaagttcatgttcaggcaaaggctgaatgtaacaaatggagtgactaagggtctcacatagaccagaaagcataaatatgcaaggaaggacccttgattctgctttctgttctccttaaaggtggctgagagctcaatgggggtgctcagagtgtgcagatgttggatgccaaagaaaacctacttctcgaaggtgagccccagttctggtctcagttcctcttttctttctttcttttttttctttttttctttttttctttttttttttttttgagacggagtctcgctctctagcccaggctggagtgcagtggcacgattttggctcactgcaagctccacctcccgggtttacgccattctcctgcctcagcctccagcctcctcaagtagctgggactacaggcgcccgccaccacgcccggctttattttattttattttattttattttgttttatttttgtatttttagtagagatggggtttcactgtgttagccaggatggtctcgatctcctgacctcgtgatccacatgcttcggcctcccaaagtgctgggattacagacgtgagccaccacgcccagcccaccctcttttcttgttaaggatagggtgtgacaagagggtcctggctccttcttacatacatgtcccatccacaggtgggctcttaagtgcctgctggagtgagggtaggggttagggatgcggctgttctttcccaaagactactcaggggctggttagtgcagagctatcgcagcctggcgacagccctcagtcacaggcaagcttaggggaacctgtggtgcttgaaagacaaaaggcttcttgccggactgacttcaggaaacggggtagccctaaagcagtcatccccaccccattacaaagagcttctctctttcccacgctgatccttctcccccgaagaagctccgtccaagtaaatttcttaccttttttttttttttttttttgagacaaggtctggctctgtcactcaggtcgcccaggctggagtgcagtggtgcaatctcggttcactgcaacctccacctcccgggttcaagcgattctcctgcctcagcctcccgagtagctgggactacaggccgtgccaccacacccggctaatttttgtatttttagtagagatggggtttcaccatgttggccaggctggtcttgaactcttgacctcaggtgatccgcccacctcgggctcccaaagtgctgggattacaggcgtgagacaccgcgcccagcccgtccaagtcaatttctagagctagaacttcctcatgctctaaagacaggaccccaactcctcagagccaggattcccaacctttcagatctggagctccccatcatgccttagagttctgtccccacgctccaatccttcagatttggatctccccttcacacacaccctcgccttgccccaaagtcagcatcccccagcgctgagatatgaagaccaccccgtcaaaggggcacacgcccagccctcagaaccggagtcccccacatcctcagagccagaacacttcatccctcaagacagagcgttattctaactcctcagagccagccccccaaatccttcccggctgggggcccctcgctctctcccatgccccagagccaggtctcgaaccacttagccccaatccttggccacagcggcccccattcgccgctttggtgcttttggcgcccccgccagagcgggctccgtaccatggtcgcggctccagcagcgggcgggcgggcttgtgacccggccaataacggttcccggggtcgcggcggcgcgcgcgcggggggcggggcagtgggcggggcctggcgtgcgccgggtggtctcgcgggcggtggcaggtgagcggcgggcggggatggcggagcaatgggagctggacgaggaaggcattcgccgcctgggggcgctgacgctggagcagccgggtagggtctggccgggagggtgtggactgggaacgtagggtcagaagctgtggaaagaaaactgaagtggaaggcggggaacctgagatagaggcgagggaaccacagagaagcggtacctgaggctggggggcggggggataacttgaggcagaaggttagagggaggtggaggtggaggaactgaagtaacgggagggtgtggggcagagcccgaggaattgagagagaagaggggagtgtgaagtagggaaggagaaacaaggttaacaggggaccctgccgcaggtgacagaactgcggggggcggtggctgaccgctgtaatcccagcactttgggaggcggaggcgggtggatcacctgagcgtggccaacatggtgaaaccccgtctctactaaaatacaaaaattagcccggcgtggtggttcaagtctataatcccagctactcgggaggctgaggcaggagaatcgcttgaacccgggaggcggaggttgcagttagccgagatcgcaccactgcactgcagcctgggcgacagagcgagactccatctcaaaaataataataataaataaaataaataaataataaaatgtctattagacatccaagtgtaaggtacctagtaggcagttggatatatgggtctggacctcagaggagaggtcagggttagagatgaaaattttggagacattagcaataggtggtatttaaagctacgggagtggatgaactcagctaaggagagaatgtcgatggagaagtgaaagaaagcttaagactcaaccttggaatatttcagtgtttagaggttgtatagaggaagaatgtggtatcttggaatttgagaaggggtagtgtatcgagcaagcaatggccaactgtgccaaatgctattgacaggctgagcaacttaaatgcagagtgtctgttagatttagcaacatggaacttactggtgaccttgacagagggagttttgggagggtggggaggagggaaaccagattggagtgggatgaaaaagggaaatgatatttgaggggaagagacagtgaaagtaagaacttttgctgaaaattttagctgtaaaagagactgcagaaatagatggtagctgaagcgtatgatgtgcagtcaagaacagaacaggaaggatatactagagcatgtcggtagtctaatgattaatttggtagaggggggaaatatgtaatatttactcattttgactgttaaaataattcaattaatttattctgtgggtaatataataattgtacagtgagggccaggcgcggtggctcacgactgtaatcccagcactctgggaggccgaggcgggcggatcacgagtcaggagatcgagaccatcctggctaacacagtgaaaccccgtctctactaaaaatacaaaaaaaattagcggagcatggtggcgggcgcctgtagtcccagctactcgggaggctgaggcaggagaatggcgtgaacccaggaggcggagcttgcagtgagccgagatcgcgccactgcactccagcctgggtgacagagtgagactccgtctcgaaaaaataaataaataaaataaaaattgtacagtgagaagaaagtctttactcccccatccccgtctcataggcctagttccccttcctaaaggcaattactgttaccagtatcttggatagttttccagaaatattctctacatatataagcatttatcacttattttataattttatattatggcaattttcaaatatatacaagagtagagataacagaataatgaactctattagcctacctcaacagttatcatcaattcatggccaagcttctttcacgtatacctcacctatcctccacccacctccaaccccctacactgactattttgaagcaaattccaagtatgtgatttcctccataaatatttcagtagtattttatttatttattgtttttattatttttcagatagagttttgctctgtcacccaggctctagggcagtggcgtgatctcggctcactgtaatctccacctccgcatttcaagcgattcttctgcctcagcctcccaagtagctgggactacaggcacccgccaccacgcccggctaattttgtattttcagtagtgacagggttttgccatgttggccaagctggtcttgaactcctgacctcaagtgatccacccacctcagcctccctaagagttgggattataagtgcaagccacagcacctggccagtatgtatttttaaaagctaagattactttaaaaaaaagtcacatatgcaacctaaaaaatttaacagtaatttctttttttggttttgttttgtttttgagatggagtctggctctgttgcccaggctggagtgcagtggcatgatctcagctcactgcaacctctgcctccagggttcaagcaattctcctgcctcagcttcctgagtagctgggatttcaggcatgtgccaccatgcctggctaatttttttgtatttttagtagagacggggtttcaccatgctagccaggctagtcttgaactcctgacctcaagtgactcagcctcctaaagtgaacagtgatttcttgatatcatgaaatatctaactagtgttcttatttccccagttgtcctataattttttaaaattagaatccatggccgggtgcgttggctcatgcctgtaatcccagcactttgggaggccaaggtgggtggatcacttgaggccaggagttcaagaccagccaggccaacatggtgaaaccccatctctattaaaaatacaaaaattagctggacatggtggctcacacctgtaatcccaactacttgggaggctgaggcaggagaatcgcttgaacccgggagacggaggttgtagtgagctgagatcgcgtcactgcactccagcttgggtggcagagcaagtctccatctaaaaaataaaataaaataagaatccgtatatggtccatatattgcaattggttgatgtatgtcttaagtcttatttgatctgtaggctccccattttttttccctcgcattttcaattgtttttgaagaaactggctttgaaagagtttactataacctgaactttgctcattgcattcctaagatgttaaacattttcccgtgttccctgtacttcctatgaattggtagttagatgaggcttaatcagattcaggttggattttttttttttcacaagacgatttcataggtaatggtgtatgtttatgttaggaagtatatggtgcctagtgttctttcttttcgtgatatcagccactgaatatgattacctaagttaattcattagggattgcaaaatggtaattgtctatttctttcatttttcttcattaactgtaatacttctataaagagaaatttcctcacatcaactgtttgcttatcctgaggtacagtttgtataggaaaggcagcataaaagcttgatttgttttcaccttatatgccagctttcagaatgatgagttattttcttagcattctccaaaggtgaccagtgaggactgttttgctttctcagtatcattataaactcatcgatttaaatatatgtcttagggctgggcatggtcgttcacgcctgtaatcccagcattttgggaggccaaggaggatggatcacctgaggtcaggagttcaagaccagtctgtccaacatggtgaaacctcatctgtactaaaaatacaaaaaaaattagcccggcatggtggcaggtgcctataatcccagctactcaggaggctgaggcaggagaatcacttgagcctgggaagcagaggttgcagtgaactgagatcgcaccactgcacttcagcctggacgaaagactgagactcagtctaaataaataaataaataaataaatgtcttagtcccttttctcttgtcataacagaataccatagactaggtaatttataaagaacagaagttgatttggctcatggttctggaggctgagaagtccaagagcatggtgccaacatctggtgagggtcattccatggtggaagggcagaaggtgcatgtgtgagatgtgagagagaaagagagagagagagagagagagagagagagagagagagagagagaagactgaactaattcctttattaggatagctaactcccgtgataactaactccatgataacagcatgaagccaccgttgacctaatcacctcttagaggccccacctcgcagtgctgttacattggcaattacgtttcaacatgaaagctgggcatggcggcttacacactttggaaggccagggaggaggatgaggccaggtatttgagaccagcctgggcaacacagcaagatcctgtctctacaaaaaatttaaaaattaactgggtgttggtggtgtgtacctgtagtcccagctactcaggaggctgaagtggaaggatcctctgaccccaggagttttaggctgcagtgcactatgatagtgctactgccctccagcctagttgacagagcaaggccctatctctgaataaattaatacatttcatcatgagttttggaggggacgttcaaaccatagcaatatatttcaatgtaagttttaatccattatagttcttatcataattgatgttcagtttatcctaactttagttaataggtgatctttcaagttgactcctgaggtctttttaaaaaagttttatggccaggtgtagtggctcacgcctgtaatcccagcactttgggaagccgaggggggtggatcacctgaggttgggagtttgagaccagcctggccagcatgttgaaaccccatctctactaaaaatataaaaattagctgggcggggtggcacatgcctgtaatcccagctacttgggaggctgaggcaggagaatcgcttgaaccctgaaggcggaggttgcagtaagccaagatcacaccattgcactccagcctgggcaaagagagcgaaactccatctcaaaaaaaaaaagaaaaagaaaaagttttatttattagaaacattcattgtcattataaataagctttgttaaaggttgttaattcaatttccaaatgagctgtaaatggttttcattagagagactacttgatttgttattttcaaatagcaaatttttgcccactggggttatgtaacccatatattaaaattggaagatcattcttttattcttggcatctatgctgtgcagtgtttgatttgttctctgatttgtcttcactctttataaacactgaaacggccaggcgcggtggcttacgcctgtaatcccagcactttgggaggctgaggagggcgaatcacgaggtcaggagatcgagacaaccctggctaacatgatgaaaccctgtctctactaaaaatacaaaaaaattagctgggcatggtggtgggcgcctgtagtcctagctacttgggaggctgagacaggagaatggcgtgaacctgggaggcagagcttgcagtgtgccaagatggtgccattgcactccagcctgggtgacagagcgagactccgtctcaaaaaaaaataataaataaataaataaacactgaaacgaaatgcataacctcttaagacatgcattcatgtgaatcattaaagaatgtttgtctttgtggcagtttatcattttaataattcacattccttcttaaaatgttaaaatgtctgctcttcaaaatagactgcagtgaaaggcatgagaaatgctgtgggtcattgatggaaaccataattgtccttagcttttgtcccatgttaacagactctcagggtgttagatcataacataccacagaattaccaatacactgccctcaaagtcaggaaaattttatttatttatttattttatttatttatttttttttaaaaaaaacatggtcttattctgttgcccaagctggagtgcagtggcatgatcatggctcactgcagtcccgacctcctgggctcaagcaatcctcctgactctgcctactgagtagctgggactacaggtgtgcaccaccatgcccagctaattttttctttttttgtagagatgggtgcattttaaaaagatataattcacatactataaagttcaccgttttagtatttatttatttattttgagataagaatcttgccctattgcccaggctgcagtgcagtggcccgacctcagctcactgcaacctctatcccaggttcaagtgattctcctgcctcagcatcctgagtaggtgggactgcaggcacgtcccaccataccctgctaatttttgtgtttttagtagagacagggtttcaccatgttggccaggctggtcttgaactcctgacttcaagtgatccacctgcctccgcctcccaaagtgctgaaattacaggcatgagccaccacacgtagccccatttaaaaaatatacaattcagggtcattttgtacatttacaatgttgtgcaagcatcattgctacctatatatagttccagaacattttcatcaacccattaggcagtcacacctcatttcccactacccctggctcctggcaaccagtaaactgctttctgtctctgtggatttgcctcttctgggtatttcatatcattggaatcatataatatgtagccttttctgtctggcttctttgacttagcatagtattttcattattcattcatgttttagcatgtattaatacttcattccttttttaaaaaaattaatagactttattttttagagcagttttaggtttacagagaaattgggcataaagtacagagagttctcatatacgcttaccttccttgcacctctccccacccaccccgtttcccttaattttaatatcttgcattattgtgatatattacaatttatgaaccaatattgatgcgattattaactaaagtccatagtttacattagagctcattttttgtgttgtacagttctatggtttttgacaattatgtcgtgtccaccattattattattatttttatttatttatttttttgagatggagtctcactctgttgcccaggctggagtgcagtggcgtggatctcggctcaccgcaagctctgtctcccagattcacaccattctcctgcctcagcctcccgagtagctgggactacaggtgcctgccactgtgcccggctaatttttcatatttttagtagagaccgggtttcaccatggtctcgatctcctgacctcgtgatccgcccgcctcggcttcccaaagtgctgggattacaggcgtgagccaccgcgcctggccgtccaccattattttttattttttgaggcagagtcttgttctgttgcccaggctggaatgcagtggcacgatctcggctcacagcaacctccgcctcctgggttcaagtgattctcatgcctcagcctcccaagtagctgggactgcaggcgtgtgccaccatgcctggctgatttttgtatttttagtagagacggggtttcaccatgttggccaggctggtctcgaactcccaacctcaggtgatctgcctgccccaacctcccaaagtgctgggattacaggcatgagccagcgtgcctggccagtcgtgtccaccattataataacagttttactaacctaaaaatcccctgtgccccaccatctgtttatccctccctcaccccaaacccctgacaactatcaggtgaaattcacccccgatatttcacgtaggctcttttctattttccctaagtgtcggccggcctgagaaataaagggacagagtacaaaagagagaaattttaaagctgggtgtctgggggagacatcacatgtcagcaggttccgtgatgccccctgagccataaaaccagcaagtttttattagtgattttcaaaaggggagggagtgtacgaatagggggtgggtcacatagatcacatgcttcacaaggtaataagatatcacaaggtaaatggaggcagggcgagatcacaggaccacaggaccggggtgaaattaaaattgctaatgaagtttcaggcacgcattgtcattgataacatcttatcaggaaacaggatttgagagcagacaactggtctgaccaaaatttattaggtgggaatttcctcgtcctaataagcctgggagcactacgggagaccggggcttatttcatcctacagctgtgaccataaaagacatctgcccccaaagcagccattttagaggcctcccttcagggatgcattctctttctcagggatgttccttgctgagaaaaagaattcagcgatatttctcctgtttgcttttgaaagaagagaaatatggctctgttccacctggctcaccggcaatcagagtttaaaggttatctctcttgttccctgaacattgctgttatcctgttcttttttcaaggtgcccagatttcatattgttcaaacacacatgctctacaaacaatttgtgcagttaatgcaatcatcacagggtcctgaggcaacatacatcctcctcagtttacgaagatgacggaattaagagattaaagtaaagacaggcataggaaatcacaagagtattgattggggaagtgataagtgtccatgaaaccttcacaatttatgttcttctgccatggcttcagctggtccctctgtttggggtccctgacttcccgcaacagacaaccactgatctttttttttttttttgagacagactttcgctgttgttgcccaggctggaatgcagtggcacgatcttggctcacggcagcctccacctcccgggttcaagcgattctcctgcctcagcctcccgagtagctgggattacgggcatgtgccactacgcccagctaattttgtatttttagtagagacagggtttctccaggttggtcaggctggtctcaaacccccagcctcaggtgatccgcccgtctcggtctcccaaagtgttgggattacaggcgtgagccaccgcacccggcccaaccactggtctttttattgttgcctttttcagaatgtcatatagttggaatcatatagtatgtaacctttcaaactgatttctctcacttagcaatatgtatttaaggctcctccatgtctttccgtggttaatagcccatttctttttattgctgaatagtattacactctgtggatgtaccattgtttgcttatccatttacctattgaaggacatcttggttgctcccaagttttggtaattatgaagaaagctgctgtaaacattcatgtgcaggtttgggtgtggacataaagtttcaacttgcttgagtaaataccaagggatttacttgtgtttagctttgcaagaaactgccaagttgtcttctcaggtggcttcaccattttgtattcccacccccaatgaatgagagttccttttgccccacatcctcaccaacatttagcattgtgaaagttttaagatttgggccattctaacaaatttatagtggtatctcattttaatttgtaatttcctaacgatttatgatgttgaccatttttttcatatgtttgtttagtggagtgtctggtttggggtttatttttattgctttttagagacaggttcttgctatgttgcccaggctggacttgaacttctggactcaagcaatcctgtctcagcctccccagtaactgagactacaggtatgtgccactgcatccagtttttcttttgcctactttttttttttttatggaaatagggtaatcttactttgttgcctaggttggagtgcagtggtgccatcatgactcactgtagcctggaattcttggtttcaagtgatcctcccacttcagcctaccaagtagctaggactactgggctgtgccaccacacccggctaatttttttaattttttgtagagacagggtcctactatgttgcccaggcttgtctcaaactcctggcctcaaatgatctgcctgccttggcctcccaaagtgctgggattacagacttgagccaccatgccaggcccatcattcctttttatggctgagtgatagtccttcttgtggatataccacatttttgtttattcattcatctgttgatgggcatttgggttgtttccatcttttggatattttgaataatgctgctatggatgttggtgtacaaatactgttcaggtccttgctttcaattcttttggatatatacccagaagtggagttattctattgttcttttgtgctcttattttcattatttggtcttcatttcaaaaatgacgttttaatttttattatttctttcttttatttttcttttctttcttttttttttttttgagaaggagtttcactcttgttgcccaggctggagtgcaatggtgcgactgcagcccccacctcctggattcaagtgattctcttgcctcagccttctgagtagctgggattacaggcgtgtgccactaggccaagataatttttttgtatttttagtagagacagggttttgccatgttggtcagtctggtctcaaactcctggcctcaggtgatctgcccacctcggccttccaaagtgctgggattacaggcgtgagccaccacactcggcctaatttttattatttcttgaattctgtcttctctgtattcaattttttttcttttctaatcatctttctgaatttgtctattctaatttacatttttcagttaatttccacatttttgggtctcaagatccctttacaccttaaaaaattattgagggctgggcgtggtggttcccagcactttggaacgccgaggcaggcgggtcacctgaggtcgggagtttgagaccagcctgcccaacatggagaaactccatctctactaaaaatacaaattagctgggtgtggtggcgtatgcctgtaatcccagctacttgggaggctgaggcaggagaatcgcctgaacccaggaggcagaggttgtgatgagctgagatggcaccattgcagtccagcctgggaaacaagaatgaaactccatctcaaaaaaaaaaaaattattgaggacctcaaagagcttttgttaatgtggactatatctactaatatctaccatacagaaattaaaactgagaaaaatttaaaatatttattaatttattaataggtaaccataacatagacattatgttaatataaatatttctatgaaaaataactatttcctaaaataaaaaaatagtgaggaaagtatcactgatttatattcttgcaaacctccttaatgttttgtttaaaagaagacagctagattctcatacctgcttctgtatttaatttgttatgatatattgttttacttgaaatatgtgaaaaagtctggcctcatacagaaatgtaattggaaaaggaaggaatattttaatagtctttcatcaaattttttatattcttctttgatacaatatgaaaacaggacaagtggtagtttcttaaagtttagttgaatgtggaatctgaaacaacatcaatgaaatttttgtactgttacttcagaatctattggtatatcttacatatggatgaatcttttacccatgcatgattttgtaacgttacacattggtcatttgaaaaatattgactcactaagttatgtagatcttccaaatattgacaaatttcattatataatgtttaaaaatcatgtttgttaatatcatcatcaatgtcatttgaaaaaccttttaagtgttgagaagccatcaggttcatggtggcagatacaagcttttcaaatttctaatttctgcttggaagctgaattttttttttttttttttttttttttttttttttttttttttttttagggacagagtctcgctctgttgcccaggctggagtgcagtgatgcgatcttggctcactgcaacccctgtctcctgggctgaagcaattcttctgcctcagcctcctgagtagctgggatcacaggcatgtgccaccatgcctcgctaatttttgtatttttggtagagacgtggtttcaccatgttggccaggctggtctcgaactcctgacctcaagtgatccgcccacctcagcctcccaaagtgttgggattacagacatgagccactgcacccagccatgattcattctcaaggtgccagtagcttttgctcttgcaccataagtgtaaatgttaatactgtaaaaaaaaaaaaaaaaaggcaattagtgtcttcatattattatgaaaataattctttaaaagtagttttaactttgtggacccctgtacatgtctcagggacctccaggggtttagggaccatactttgagagctgctacattgctatgatgtttttaaacttgttttgaaatattaagttacagttttcatttgtggatgtatctttctggagtgcttttaattttaggggtattattctgctccttttaaaaaaataataacctcatataagatttgactataatccttttctgtggctctttaagtgcagttaagttttcttacacttaggtgggaaaggtgggccagaatagcttttttagtttcaaggttttggagctccctcttctgttgtgttcacagagtagtgtaaaacatgacatgcttcctgagatccgtccattctgcttccctcccctattcatatctggaccttttatttcctttgcatctatgtccctgttccattcagtgtagattctactcccactaatttctccgtggtatgggtcttgtcctgaaagggatctttggtttatgactatttaaagcttatgggggccaggcacggtggctgacgcctgtaatcccaccactttgggaggccaagtcaggtggatcacctgaggtcaggagtttgagaccagcctgggtaacatggtgaaaccccgtctctactgaaagtacaaaaattagccaggcatagtggcacacaccttaatcccacctacttgggaggctgaggcaggagaatcacttgaacccaggagatggaggttgcagtgagccaagatcgcaccattgcactccagcctgggtgacaagagtgagattccatctcaataaataaataaataataaaataaaataaagtttatgggacccagactgctctagcaacttaagatcttatttcaatgcagtctcctggcacttatctgcaaactggattctgtagaactctcttccagttttggttgctattcgcagtttggcctaccacccttgccagtgagttcttactgacaattttgagattctccccttttcaggactgttaatagtctagttgatgcccaggctcagtggctcatgcctgtaatcccagcactttgggaggctgaggctgagactggtggatcacctgaggtcaggagttcaagagcagcttggcaaaaccccgtttctacctaaaatacaaaaaattagccgggtgtggtggtgcacacctgtgttcccagctacttgggaggctgaggcaggagaatctcttgaacttgggaggtggaggttgcagtgagctgagatcacaccactgcactccagcttgggcgaaagagcaagactccatctcaaaaaaaatagaaaaaaaagtctagttgacttttatctacttcttctcatatatgtatattctatatatatactctatagaatatataccacatatactctatagaatatataccacatatactctatagaatatataccacatatactctatagaatatataccacatatactctatagaatatataccacatatactctatagaatatatactacatatactctatagaatatatactacatatactctatagaatatagaatatgtactacatatactctatagaatatagaatatgtactacatatattctatagaatatagaatatgtatattatatatagaatatgtattctatagaatatgtactctacatattctatagaatatgtactctacatattctatagaatatgtactctacatattctatagaatatgtactctacatattctatagaatatgtactctacatattctatagaatatgtactctacatattctatagaatatgtactctacatattctatatatagatttaatatatgtcatttaatatataatttaatatatataattatatataattatatatattctatatatactatagcctatctatagtctatagacagtctatagactatagactatagactatatatagtctatatatatgttttgtacatatgcattaatttaattcttgtaacaccttatgaattgagtaccattgttacccccattttacagatgaggaaactgatgcacaaagaggttaagtgacttgaacaaggtcgcagatgtagtatattgtctttcgtatcaatgtactattatttaggctgtctggctctatttttctgctgatggacctttgacagttttctatttctttctttttaattttttttactatcttaaaaccgctctgaaattgacatccttgtgctatattttatataacctgccaaaattttgtggttattatccatagggctaaatcctagcagtggggttgctgaatatcttttgaaattttgttttgagaacttttggagacttttagtacatccttcagggaaattagaaaaactcaagggctctataaaactaaggttcaatgtcactatattagaccatactgctgcttttaaaaagaagatctgatcttatgaggcttggatgtagggccttgcacagttgagatatgggaggaagaaaggcctactttcactgactctgctgttgatccgagcagggatcataatatatctactgatgatctcttttcagaactggtggagtctctttcattgcagggatcttatgctggcaaaatccattccattggtgatgccttcagaaattttaaaaatctccgatccttagatttatcaaggaatttgatcactagccttaaggtaagttatatattctatgaccagccaggtctgcccaatttatttttttgatgggaagaaataagagatagatcatgtcatcctggggaatataagaccttccctttaaatgattcccaactaaatttaattatttcttataaaattctttcaactttgcagtatattttaaattgttataaaatattgggagggcaatttattttatactctcggaaaactatattaagatatcactgtctagggcaaatgcataaattttagtgtgtataaaaaattatgaagaacacttgtagaagtacagattctcagtccctactgtgagagttggtctgatttagtaggtctagggtaggctcaggacatactcaggggattctgatgatggtggtacatggagcatacatggagaaacactggcctgtgttgttattgtgagttttttctatgaggagaaggaaggtgtggtcttgggaaaatttaagtcaggggatgatggagcagagggcagtataggaaggcaggagggaccaagcatgaacagtgtgcgtgtggattagcaaacacgcacaaagaactctacaaacatgagtgtgcacacacagagatggagttttgttttctttgtggtagacccccaaatactgcttcttcctcatgttcccattttgcccaagctctgcacctgtcttggcaaagcccttctatgcaagatcgagcgtgacaaagactcacagatgctatccaggattagttactgatcttctgggtcatctaccagttttgcacttcctaggggatatttgttcaacaacacatccagacccaatcccaaggtttagctaagggcctaaaagatcaaaagccctaagatcaaatttccatctaggactctaaaatcagcaactccaagttcaactaggtctttagactattttttagcagccatttatatttggcctatcagtttcagaaaggattagttctttcacaggtgataggatccaatttaaaaaatgaaaagataaaatataaaaagaaagtattagttcagagttgcttaggtctcctcttttgtttgtttattctttttctggctaaaaaattaagtgaacattgctgtaatttgtttttatacttcctttctttcacttcggtaaactgggtgaaaaacttaggaaaataatcaaattagggctgggcacggtgactcacacctataatgcagcgcttcggaaggctgaggcaggcagattgcttgagcccaggagttcaagaccagcctgagcaacatagtgagacccctatctctattttaaaaaatcaagttgtctggtcacggtggctcatgcctgtaatctcagcactttgggaggccaaggtgggtggatcccgaagtcaggagttcgagaccagcttggccaacatggtgaaaccccgtctctactaaaaatacaaaaattagccaggcgtggtggcaggcgcctgtagtcccagctacttgggaggctgaaggaggagaattgcttgaacctgggaggcagaggttgcagtgagcctagatcgcaccactacactccagcctgggcaaaagagtgagaccatctcaaaaaaaaaaaaaatcaagttaacacgtgtaatcaaatagaacatatataagactcctggtacagtgcttggcatataggaagcactcagtaatgttagttttctatattttttgcatctatgatttttatttattttttttgagacagagtctcactctgtcgtccaggttggagtgcagtagtgtgatcttggctcactgcaacctccgcctcccaggttcaggagattctcctgactcagcctcctgagtagctgagattacaggcacccaccaccacacccagctaatttttgtatttttagtaaagacagggtttcaccatgttagccaggttggtctcaaactcctgacctcaggtgatctgcccacctcagcctcccaaagtgctgggattagaggcatgagccaccatgcccagccacatctgtgattttatattaatctttaacagttctgaatccctttgtttaattttcctgggagaaaatgttttgtgattatttgtagcgtaactttggggaatacataaattcatgacaactggtaaaagtgagaggataagagtttccttaatttttacactgagagacattaaaagattacttaagccaggtgtggtggtttatgtctgtaatcccagcactttgggaggctgaggcaggaggatcacttgaggcaaggagtttgagactagcttgagcaataaagcaagaccctgtctctacaaaacagaaacaaacaaacaaacaaaaaccatagttgttggtgcgtgcctataatcccagctatttgggaggctgaagcaggaggatcccttgccctaggagttcaaggctgcagtgagccttgttcatgccactacactccagcctgggtgacagagcaagatcctctcagaaaaaaccaaaaaacaaaaaaacttgagctgggccattagaccatgaaagacagtcctaatggtgcactgccctgagagtgaggccaagggcactgatagctattcctcaccactgacccattaacaatatggaagttaatggaattggagaaaacaacaacaacaaaaaaaacaaatacaaaacagaaagaaatgcatcaaagtataaacagggttgtgttgggaatgttttgtatctatctttgggttttctaaatttcttgcaatgagaaaatgataattttaaatgggaggagaataaaaacattattttataaatacatgatggaaaataatttcacctttccaaaataattctcaatgacagaattccttttatggaaagcatttttactatttttttttttgcatttgtactattaaaagtatatgattaaccaggcacagtggctcatgcctgtaatcccaacactttgggaggccaaggcaggataattgcttgagctcaggagttcaagaccagcctgggcaacatagtgagacattgtctctactaaaaatcaaaaaatagttagccaggtgtggtgccacatgcctgtattcccagctactcaggggctgaggcgagagcatcacttgagcccaggaagtcagggctgcagtgagctctgatcgtaccactgcactccagcctgggcgatagagtgataccctgtctcaaaaaaaaaaaaaaaaagtatgcgattatacatatgtacatgttttgaaattgtcctgaaatttagtattgggcaaaagcagctaactagctaaatacataaagatgaaatcttttcaatagcaggtttcagcagaggaagaaaactgtggcttttcctcttgagtttgccaggcctgattgtactgttgccagttaggtagagggtggggttgctaaatccacaagaaagagaactgaacaaggaagaacatttctgcaaaggagaactgactgattgattaaatgggaagcttgcgtggtagcaggaactctgaagaggaaaacagtctaggaggcctagactggtccaggagtgaggacttggagatagcattgttttgtttccctaaatagtcctttgaccatataagtgaggcactgagatatgagaacacaacacaacacacacacacatacacacacacacacttttttttttttaaccatgcccctttcccccagaaccagcttttttgcttacctcccttcttcttgtaaattaaggtgcttttgggatcaggagaggggttgggacaaaagtgagagaattctaatgtggcttggccactgggaaaccactgtgaaggattggattgcattgggagaataattggagagccaacagaagtggagaattgactgcagatatttgagtgtcagattttgtaaagaaggaaatgtattatatatgtgaattatttaacgtatggaacacccagtgctcatggactgcagtggtcttattttcggacaagttaagtgagagttccagccctgcctttctcacggggacttggataacatgtttaaggacggaaagtaacatatatttccatctttatctatgaggttcctagtctttaccaatatgccatttcataatgtggtgttttccttgtagggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattaggtaagaccttccttctctgttcctgtccacagaatcttactttaaatcagctgccccttaaccttttggatgttggcccacagtgtgcactggcaggatatatttgtttattagtcaatatttatgtaactcttttgtgttggcaggatgtatgacgagttcttttattgtttattgaatgacagtctatgattttattagttacttccagctttagttttcttcagttgatggtttcaccgccccttcctcctcaacacaaaatttccaggttgagaattatttttccaggtgccccaactttgcaactgtattagcaatagaaagctaatacaatttatttgggggcttagttgggggcttagttgaagaaatattccttcaaatgagctggtctatattttcttattattttactttattttttatttatttatttattttgagacagggtctcactctgttgcccaggctggagtgcagtggcacgatcttggctcactgccgcctggacctcccaggctcaagcaattctcacatctcagtctcccaagtagctggaactacaggcacgcaccaccacacccagctaatttttgtgttttttgtagagatggggtttcatcatgttgcccagactggacttccttataattttattgttgagtatacatttcttattgatacaaaattggatttcacatggccctgggaaagtaattgtagggaaactaagtaaactctttcagacaatggtatgactttcagccctaacattaggcctttgaattgtttactgtccaagctctgctttcctgaagggtagttacaactgtgaggcagtggtcgctatggcttcctgcagtctccctgagttcctgcctgctccagtgacaacataatagcattattttgtgacctgtctctaacacaccaagatgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaaggtaagaagattctttacaaaatttttaaagtttggttctggacataggaaatagtgaattcctgcttagctttcttcattttccagcagaaatttcccacaaattgtaagaatcctcagatcaggaataaaagtatttattctgcaaactgagatttatctgggatgataatctggccctcagtgggtacattcctgttttcttgaactttgggtataattgttagaaattctctaaagttgttgttcacaggttatagatagggatactatgagattacttattcctataaatgcttaccaactctttctcagtagagttatcaatcagttcctgatcttgtcctattgaattaggattacattaccatgggcaagattgttagagataaatttgttaaaggaagggaagagaagcatttctcttcgaaacaaaaagtgaacaaacattgaggctctaaaatttctgaatggtagctttgtccattactaaaatcctatcaaaagaagttaccattatcttctacccccaaacctatgctttttaaaaagtagttttattattttttaaaaatagatagcagtccattacaattttaataatacagaaaagtacactgaaaaaagtcaaaatcacttcatatcctacaattgagagttaactattagtaatgtttggtatatatccttccagatatccttgtactatagacacatatagataatatcagcattttttctgatgacaaaggtaatacatgcttattgttgagaatttggaaagtacagaaaaaaacacaagggataaaataagtaattcataatcctaccattcagaaagaaacattcattatattctggtaaatatcctttttttttttctttttgagacggagtcttgctctgtcacccaggctggagtgcagtggtgcgatcttggctcactacaacctccacctcccgggttcaagtgattctgctgcctcagcctcctgtgtagctgggattacaggtgcacaccactgcctagctcaccatttttaatttaacaagctatcatgaacatatccccacaacattattcttatattattctccagaataagtcttttgtttgtttattgcttttacctttactactagaacataaactccatgagaacaaggatcttgttggtcttgcttattacagtatcccagttgctagaaccgtgtctggaatacagacgatgctaagaaataatgtattgaatgatgaatgaatgaggtcagtgcctattggcctgagatccttccctttcccagtgactttgcctgtctctgctctgatccattatatgttttttagtgcagccttcagtgaacattcttagtttcctatttttttcttagtttcctattttttaaaatcagatttattgaggttactttgcatggaatagtcactcttctttagatagaaattgaatgcttctaaaacattgtttatatgttttgtggattaatttctattttaaatgcaatgggtaacattcactacaaaaatacagagattaattaatgtgtaactgaataaaccttctaataaacagataaattaattccatcatttatctgtttatttaccatataatgattgcaaaactggaggaaaaatgttactcaagtaccctgtattaacattaatatcttataagctctctaaccttgggtgaagtttttttttttttaagcctttctgagtcccagttcccccacctataaaatggagataatgaccagtagggggccttttatgattacatgaaatggtgattataaagcatctgatacatacagcctaggctttgtgtacttactgtactacccaaggtatctacctgcctttcttgtctgcttttctaaataatggctatagttgtctcctctataattcttggcagcagaaccttcctttctgtgtcctaactatgagtgttttaattcaaaagaaactgtcctaccccctcaatcattcagatctaagtatgtgtcaagaaaacagagtatctaagttctaaatcttctggctttcacattttacaggctgaactatagtgtccttctctcatatttcccagtataaatattactttttcttataaagtatggctttaactgaaatatttgtgcaacttttttttttttggagacagagtcttgctctgtcacccaaactggagtacagtggcgtgatctcagctcactgcaacctctgcctcctgggttcaagtgattctcctgcctcagccttctgagtagctgggactacaggcacccgccaccacacgtggctgatttttgtatttttagtagagacagggtttcgccatgttggccaggctggtcttgaactcctgacctcaggtgatccacccgcctcggcctcccaaagtgctgggattacaggggtgagccactgtgcccggctgaaacataattaaattaatatgttctagagcatttgagaaaaatctgatcaccatagactgctttctaaatagcatttactggtgatctcagaagccttttttttttttttgagttgtaaataaattattctatgtggcagctctagggagaagacaatgaaaaactgtgtaacaggtgagagctctgcatcaaaagtcagtgctaatgttgacagcaggattgaaatgggtaagttttctccctgtgattataaaatgattaaaacatcagttatctcagctgccatagccaatattgggtaagatgaagacacatagttgagaaagaaccaatttgaagcaagcacaggtttactggctgtgtttttcttccatcctctcactgccagaaggaccttacagagcaggcctaacccagagcccatgaaagcacaagctgtacttggagagttcaatttcatttacatcactttacatcattagtatacccagaaaattacatcagtgattgatttaattagagactggcgactcatctgcatacatccagctcacaccctgggcttcctgggctgcccaaccaagaacctttgcagctgtagaatctcttgtgtttgggatatattactggggaatgtttactatattcctgtaaatacagttgataagccaatatagctaaagtggttatgccaggctgggcacagtggctcacgcctgtaatcccagcactttgggaggccgaggcagacagatcacctgaggttgcgagtttaagaccagcctgaccgacatggagaaaccctgtctctactaaaaatacaaaattagccgggcttggtggcgcatgcctgtaatcccatctactcgggaggctgaggcaggagaatcacttgaacctgggaggcagaggttgtggtgagccgagatcacgccattgcactccagcctaggcaacaaaagtgaaactccatcttaaaaaaataaataaataaaaaataaataaagtggttatgccacattaatggtcatgtcacaggccgggagaaagctttccaccagagaagttgcatccagtgaatccttgtggattagcttggcactgtcagataaatcaagtgaccttttacttgagaaaatattcttcggtctcagtgcctcttcccttggaagaatctagtgaattatacacaaactctaaacatcaattcctaaaagccaagcaataactttagtagattgactctacactgtagttcagacattaagcattttcggtttataacatgtattttattttcttgatttcttatcatttattgacaaatgatttttagagtattttgtgataaaatgagacacgggccgggcatggtggctcacacctgtaatctcagcactttgggaggctgagatgggcagatcacctaaggccaggaattcaacacctgcctggccaacatggcaaaaccccatctctactaaaaatacaaaaattagccatgcgtggtggcacatgcttgcaatcccagctacttgagtggctgaggcatgagaattgcttgaacccgggaagcggaggttgcagtgagcccagattgcgccactgcactctagcctgagcgacagagtgagactctgtctcaaaaaacaaacacacaaaaagacataatgaggtgtgactttaatgttcatttcttggatgtcccagtacatataaatattgggagtatggattactttatttcattttaaatagcatttttaatatttttaaattgatacaattttattgtaataattttggaaaagactgaaaagcatgaaaaacaacattttggtcctagttaatgctttggtatacagccttccttggtataccacctttggtatacagcctagtcttttttctaggtacaggcatttaagtatccatttccagacagagaaaaatacattgaagcataatttgacaacctgtttttgtataagctgaattagacttcatttgtgccatattacttcattaacacaattaaaaagtctgaaagtgtactttctcttctaagaacaaactgctttgctagagggcccatttctaaaggttcttagaagccccagctgttgcctggattttttttaatataaaatttattttgctacttcgaaacgttaaggagctttgttttccactgaaaattgtgtttgtgctggattccctggggagtgttgccagtaagcactgttggtaatccaatatgatcaaagtggttatgccatgttaatggccatgccacaggctaggagaaaactttctggagaacatctctcactagctcagttgttcccaatggtgttttcccaccaatcattgcgaatgggcactgaacctccactgtcttggatcctcctcttattctcctaaccacataatcattgactctttgaaaggttcctctctctcttcccatatccccgaaataggcgtacctaggctatatctttgggctctcctgttttttctctttgcccctattgatctcatctattttacggccttatttataaataaataaatgtcttatttatttatttatttatttatttatttatttatttatttatttattttttgaggcagggtctcattctgttgcccaggctggagtgcagtggtgcaaactcagctcactgcaacctctgcctcctaggctcaagccatcctcccagttcatcctcctgagtagctgggactacaggtgtgtgctaccatgcacagctaagttttgtatttttttgcagagagggggttttgccatttttccatgttgcccaggctggtcttgaactcctgagctcaagcaattttcccccctcagcctcccaaagtgctaggattataggcgtgagccactgtgcccagcctgtttatttatttatatttattttatagtctttcctcatatcttaaatatattggtctagctttgacaacctgcactggtctctctctgcaccaggcccatatttctgttgaccaacttgtaatatacacttggaatcaccactgtttaacagcctctcaagctaaacatgtccaaaataacccccaaaacaaacaaacaaataagcccctctccctcaaccctaaacagctcctagggtttcatcagtattaccacagctttcccattaccctggcccagaatcatgttggggtttgatgctgctgctactctgagctgaatgttcatgccctgtagtatgatccacaattgacgagccttcctttccatttctttttttattttttgtttttgtttttgttttgttttgtttttttgagacagagtctcactgtgtcatccaggctggagtacagtggcgagatctcggctcactgcaacctttgcctcccaagttcaagcaattctcgtgcctcagcctttggaatagctgggattacaggtgcgcaccaacatgcccagctaatttttgtatttttagtggagacagggtttcaccatgttgatcaggctggtctcgaactcctggcctcaagtgacccacgttcctcggcctcccaaggtgctgggattatagcacgtccagcccctttccatttcttgatagtctcttaccaggcatggttaattatctcagttaatcctcacaacaaccttgaaggtggttctacaggtgaggaaactgatacccaaagaggggaaataacttgccctagttatgcagtaagtggcagagctaggaggcaaactctggtccatctgtcatcaaagtcctcttaaccattacatgatactgcttcacagtctcttactccttcaattcattttgtactttgctgccagattaattctcttaaaacacagctgtgatgatttattatgcttgcctgctcaaaaacttctctggctcccactcccctactaaattaagtctaaactcctttacttggtgtataagactcccctaagctctatctgtaatttgtctcttcagcctaagctgaaagcttatctcctgtttgtcaactacaatgtccaatactcaatcaaaccactccttcctcccccaaatagtccttcctttctccctcctctgtccctaaactaatgctgtccccctgcttgtaatgctttactcaaatcctacccttctttatgacccagaccaaagcccatccattttaatgaaactttttttgtttgtttttgagacagagtctcactcagttgctcaggctggagtgcagtggcgtcatctcggcttattgcaacttccacctcccgggttcaagtgattctcatgtctcacctgcccgaatacctgggattacaggcgtgtaccaccacgcctggttaatatttgtgtttttagtagagatagggttttaccatgttggccaggctggtctgaaacccctaacctcaagtgatccacccacctgggcctcccaaagtgctaggattacagatgtgaaacactgcacctggccaataatctgatttttaaaacatattttattttttagaacagttttagattcacagcaaaatttatcaggcagtagagttcccatataccctacctgcacacatgcacagcctccctgactatggacatcctgccccagagtggtacatttgttacaattggataaacctgcactgacacatcattataacccaaagttcacagtttacattaggtttcgttcttggtgttgtacattctatgggcttgatgaatgtataaacgacatgtatctactgttgtagtatcatacaaaaatagcttcactgccctatgaattctctgtgcttacctatttattccttcatcctctctaatccctggcaaccactgatctttatactgtctccatagtattgccttttccagaatgtcatatagttggaatcattcagtatgtagcctttcagattggcttctttcacttagcaatatacacttaaatttcctccatgccttttcatggcttgacagctcatttcttcttagtgctgaataatattttattgtctggatgtaccacagtttatttatccactcacccactgaaagacatcttggttgcttccaagttttggcaattatgactagaactgttataaacaaccttgtgcaggtttttgtgtgggcataagttttcaactcatttgagtacttaccaaagaacatgattgctggatcatataacagtatgttgagctttgtaagaaactgccaaattgttccaatataatctttttaagatgtctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcactgttttagccgggatggtctcgatctcctgacctcatgatccgcccgcctcggcctcccaaagtgctgggattacaggcgtgagccaccgcgcccggtcttttaagatgtctttttatatactgagtttagtttcttatagtttctcaaactggactcctgttctcagagttgattagaacattgagcttgagaaacactgatgtggctggtgacatgctacagaagcccactgtgtgctggggacagtggagaaaggttttatggcagatatggaaacaaagccatcagaccttacaggctggagagcaatgggatggcctgaaaagaggagcagcacattttgattggtggggttggtgtgaattactgtctggaagtggtaaggaggatggtaggtcatgaagaaagccatgtgtcggtgtggtttgggtggaaggtttatgttgggtagaaggtcaggttctggagaacagtgaatgtcttactaagaacaatttacgtttatcctgtaggtactagttgaaacaacctaactcactctttttgccagttctatttgcctttaaatagagtcttgctgaaaatatactgatctaatatcttattctaaaataacaaggaaaaatccaccacagccaccctcagtggctcattcctgtgtctagcagatgtgtcagggtcttctttataactcattgaaatccatcccacttcaacatgttgatccatgtcatctcttggtttagccatgatggagttttggctgaataaaaatcagcttggaatagcagagacttctcaaaatagtcacttaaactagaagttcatttatctctcttatagaaatccagatgttgacagtctacggctgtcatggggagagttctaagggaggaataatgaatatgggggagaggcagttagcaatctcagtcagtggaaatgagagcaattcagcaaagaagtgcatatctactgggcaaatcctgtgttgggggtaggcagacaaggacatgattaaaatagtgtcacgtcttcacatactcccattttggaaagatttattgcagctaattaggtcacaagtcaggcttcactgtgagacaagagctctactatggcagagatatagagggatggaggagaggcggttgcagttagtactcattgcaggcctgggaaaaggctgcacaaaacaacactttagttgggcattaaaatagagttcagtgggcatagttgaggggaaaaggtattcaatgtagagggaaaagcagcagcaaagacaggtgaaacatatcaggaaattgactcagcttgtggctagagataaggccaagttgcaaaggccctctttactaattatgttcattttattctcttgaaaataggtaataataaggatctcttagaggtgaggcatgcttaaacgtgtgatttgagagataactcaagctagatttagttagtgggaggtaatgaggacctgtcctcggaggccaatggtaaaatgcagatgaggaagcacagattgattaagtcctggaggatacgaaaataaagcctggatacaaaacatgaagtatttttacctgcagtgttttgctatatagttcaaacttcagaagaatggaatttctgaataaaagacacaactattatttaaagggggaaaaatacaaggttactaagattacatggagtctgttcatgatgggaaaaaaaccacctcaccaatttcctttaataattatcatatctgcaatagttattacatattaatattttaaatgtcagggattgtgttgtttttattggtaattagcaatggaaaagaaatggttttggagactagtgaaagacaagttatttctgctcttatatttttatctcagtggaatctggggtacaatatgtttatttgagattaacactgagaggaaggggaggaaagagggttaagcagagagagagctctagagtaagaactttccttcagaatgtcccttactaggctgaaatgcctgggtctttgtacccctgcctagctctgtcacggggagtgaactgtccttggaagagaatggcatcaggagatggttcttgatagctaagacagactccgaatgaagagcaaacggctgaagtgccctccagcagctaggcagcaagtccttccttgaaggggatctggccagatctcagcctcccattgattgcagggtgtttgtacaaacatgtgaagtggagcctcatccagctgggattactggtagtagaagtagctattagttacttgcccctgtatctgtatgataaagccttttctctgttattacaaatagaaaacaattttcaaacaaattgtcctgtcgcattgattatatggatgttcaaacctgggctggacaacaggtcataattacatttgcttttggaattaagggctggatatattttgtatctgaagaaaaagaataaactgaagtataagacaagaaaaaaataatctcagaatacaaattgcttcattttcttgattgttgtatatgacgtacttagtcataatagtggcagagcaaggcatcagttttttttttttttcaagagtgatcctgtatcttggatatgacacaaaaaacaaccaaaagacttcataaaaattaaaatttttgtgttttaaaggacactatcaaagtggaaagacaacccacagaataggagaaaatgtttgcagactgtatatctgacaaggatctaattaatattcattctatatttttaaaaaccggaatgtagtggcatgcccaggctgcagtacagtggcacagtcacagctcactgcaacctcaaactcctgggcttaagtgatattcctgcctcctgagtagcagggactacaggcatgtcgccactaatttttttttttttttttgcacccagctattttattttttgtggagataaggtcttgctatgttgcccaggctggtcttgaactcttggcctgaagcgaccctcacaccttggcctcttaaagtgctgggattacaggcatgagctaacgtattcaacccattctacataaagaactcttacaactcaataacaaaaagacaaaaacaacccaattaaaaaaaatgtgggcagagaatttgaatagacatttctccaaagaagatatgcagctggccaaaagcacatgaaagatgctcaacatcactattcatctgggaaatgcaaagcaaaactacaaggagataccacttcacatccactaggccaaatagaatctaaaggacagataataagcaatggctgggagggtgggaggaaggggaggagcagaaaagataactgttgaatactgggcttaatatccagtgatgaagtaacatgtataaaaaataagatatgttttgcaatttaaaaagttgctataaaaaaagcaatgtcaaggatgtgcagaaattggagtccttatgcatcgctggtaggaaagtaaaattgtgcaactgttttggaaaacagtctggcagttcctcaaaaagttaaacatagagttaaatttgatccagcaattccactcctaggtatatatacctaagagaaatggaaacctatgttcatacaaaaacttgtccaggaatgaaagcagcattattcataatagccattgactgaagaatgaataaacaaaatatgatatatccatattcaggcattaaaaaggaatgaagtactaacacatgctataacatgtattttgaaaacatcaggctaagtgaaagaagccagacaaaaaggtcatatattgtatgattccatttatataaaatttgcagaataggccattgcatagagacagaaagtatattgttggttgccagaggatggaagggagggaaaaattgggaatgacagctatggggtttcttttgggggtgatgaaatattctagaattagatagtggtgatagttgtataactttgtgaatatactaaaaaacactgaattgtacactataaaaggatgaattgtatgacacatgaattatatctcaattaaaataaagcttctcccacagtcatagagtgattctgtacaacttggtaattgagatttcagatgagtcaaataacaagtttgtatcttaagtgattgggtgatagtaatgccaataacaagattgggggaggcaccagcagcagaagtaggcctggaagtgaagataatgagtttggttagaaaatactgatttttggctgggcatggtggctcactactgtaatcccaacaatttgggaggccaaggtgggcggatcatttgaggtcaggagttcgagaccagcctgacaaacacagtgaaaccccatcttcactaaaaatacaaaaaaatttgctgggcgtggtggtgcatacctgtagtcccagctactcaggaggctgaggcgggagaattgcttgaagccgggaggcggaggttgcagtgagccgagattgcgccattgcactccagagcctgagcaacagagcaagactctgtctcaaaaaaaaaaaaaagaaaagaaaatattgactttttggttgtgtgcaggtactcattgggggctgttcaggaaatttaggtctgtacatcagaagagagaccagacttaagagatttagatttagagtcactcagatgtaagtgatagctaaaacccaggagaactatgagagcactcagcaagaagttcaggcggtaggggatttgaaccaagacataggttgaaagaaaaggaacctgtgaatctggaaaagagcatatgtgctgtgggaggaaaaacaggctggagcagggtcttgaacacctgcgaagtcttgttccacaggataagagtaagaggagccctgaacccaaagtcacagcctactaaccattctcatttgcacaaaagctgtgttacaactagcagtttctgcttcaccttgtttcttctgtagtactactgcagtgagaacaggacaaaaaggttgatagctcatgtcacttgcagaaaagtagttctgtcgagtccagtggttggaagagcatcttgtgtttaagtaggacgtttcagtcccagaaggcaattcagaaatagaaggcatcttagagcctcagatggatggaggggctggttctcaagaggctggctttattcactgtctactctcagttgcactggcttgtagtgactttctgttgccagaaccagtagatgaaagtgagcataagagcacattgtttgacaaaggcccaaattcttgctactatcttcttacataatcctgctggaaaaaaattccttaaacaaaagcaaaactcttgttttcattcaagtccccccagaagacctcaaatcccagaattatacgttaataaatgtattgatcaagagtggaaaaacgtttgtacaaatatgacaacctaatagaatcgttctctctttcttgtcattcttgtctcactcctgttactcaggctggagtgcagtggcacaatcttggttcattgcagtctcgacttcccaagttaagggttcctcccacctcagcctcccaaatagctgggactcatgccactaagcctggctcatttttgtattttcaatagagatgggggtctcactatgttgcccaggctggtgttgaactcctgggctcaagtgatccacccacctgggcctcccaaagtgttgggattacagacacgagccactgtgcctggcctttgatagaattgctgacaggctcttcttgataacagtttccaaagtggccagaactgggctacagtttttgttatttttactttttatttttaaaataatttttctaatcacagtaaaaatattggtaaaaaaataaaattataatacaggaaaaaaagttaaaatttatcacttttttgtgaatatatgtattaaactaacatcagaatttgaaaggtgaactgcaaaatactaatgagattttctcttttcttttggaaatggagtctcactctgtcacccaggctggagtgcaatggtgcgatctcagctcacagcaacctctgcttcccgggttcaagcgattctcctgcctcagcctcttgagtagctgggattacaggcgcccacgcctggctgatttttttatttttagtagagacggagtttcaccatgttggccacgctggtctcgaactcctgacctcaggtgatccacccaccttggcctcccaaagtgctgaaattataggtatgagccaccatgcctggccctaacagtattttttaatgaaaatggaacactatttcctttacttttaaaaaattatttttctttaactataaaacaaatcttaccaggcctggtggctcacgcgtgtaatcccaacactttaggaagccaaggctggcagattgcttgagcccaggagttctaaaccagcctgggcaacatacggataccctatttctattaaaacttttttttaatgtaaaaattaaaaaaaacaaaaacaaaaacaaatctcacacaaaataacatacagagtgttctaatacgttttgttttgttttgttttttcttcccgagaaagagtcttgctctgtcgcccagactggagtgctgtggcgcgatctcggctcactgcaacctctacctcctgggttcaagcagttctcctgcctcagcctagcgagcagctgggattacaggtgtgcaccataacgcccagctaatttttgtatttttagtagagacgggatttcaccaggctggccaggctggtctcaaactcctgacctcatcatccgcccgcctcagcctcccaaagtgctgggactacaaatgtgagtcaccgtgcctggccagaagtttgaatatatatacagagcctaaagtactactaataaatatatttaagctcatggtgaatatttccagccccatcactaatttaatcaatttacaaggattttataaatagcaggggatgatacttccacattctctgtgtggtaaccaaaaaacaagataaaacaagaatctctctaatagcattagttacaattgaataaaacaaaataaactgtaaaaaatacattgggagacctaaggatttagcattcttctccatgaaataggtcctgactggtttctctctcttttttttgtttttgttgttgttgttgttgttgttttattgagatagagtctcactgtgtcgcccaggctggagtgcagtggcacagtcgtggctcactgcaacctccacctccctggttcaagcaattctcctgccttagcctcctgagtagctgggattataggcgcgcgccaccactcccggcccggctaatttttgtatttttagtagagacagagtttcaccatgatggtcaggctggtctcgaactcctaacctcaagtgatctgcccacctcagcctcccaaagtgctgggattacaggcgtgagccaccacgcccagcttagttttctctttttacaaaagagagaaagcaaggcagaaaaaggctagtttgaaatggtcaatcagtgctgactgctgattagtaccctggagatgtataatgccaggagtctattcccagcatctccccctgtagttggagattatggaattggtatcacagttaattatttattcgcttaggaaatgtgcaaaatatttgccttccactcagtttctgttgagcacttcataaattatgaagccatttcatatccattatcctgttttaacctggctcaaccctaacagataggcagtttagattttatcatctctgttttccaaacgaagtgagagaagtagagaggttaagtgatttgctcaaattcatgtggtctccaagtggtggcaccagaactagcactcaatcttgtgactttccttttagtatctatccattagacatgctgcctttgaagtctggtcagtgagtgctttattgtttgctttttcttttaacacagactcaaacaaaggactttttattcccttccccaaccgggaaataaaggattccctaagtacttctgcaactcagggcaatggtacacgtgatcagaaattagacaccttcccactggggacacaggtaatgtattcactctcctgctgatctgttgactagtcaatgattaatactgataattcagtgggctctcaattatttatgaaggtctcagaggacttgtttgatgaaggcattttagacccttttaaaggaaagggcaggacagaatgcagagtaccttctccattaatttcaatctcccatttccctctctctcacactaacctgttatctaatgtcatatatttatacatataactttagcatatctatgaaaggcattttggtcctcaaacaagaatgcaactgttacagtttttggctggttttaaattttctcccctctatccaatatctccatctcctgttgccttgcttcttacattttctacctacaccctttaatactgagtcttacattttaggtatgactttcccaaagctgcctctgcagtataacagaaaaagtaaagtttaaggggtaaagatggcatggaagttgtgggcaatgggaagatagagatcatgcaagatgggggaggagtgaaaaataaggttttagtgaaaaaattggtgacagaagggatgcaaccattatgtaagacttgtttgtgtgagtgaatatgatacaaggagcagaactgactactttatattcaccttctccctttctgtgccttttctttgatacatttatgagcaataaaattgtagaaaatagccaggaggagaaagaaaagcagcaaaggctctgattaatccataatttggacaatcaagactgaattagtaaaaagttagtactattcttttcagtttgggtatagactaccttcatcttttaaaaagataagcatttaatcagtttctttgtttttggagattatacttgggtgacttagaaacaatctcagttaccattttttaaaaccatattgacttaaggaaatggagacaaagagtattgcaatctccagttaaatagcacttcttagataaaaaagcaaacaaaaaaacttctctgaaattacttcttgaagtgagaaaaaaggaaattgaatagtttgctgtatctttttagtttaagaaataaggaagtgggatttctttctctccatgactaccaaaaagacactgaatactttaagataatttttttaaaagcaaaccctagatggctttctgttttccttcagtccttgcctagttatgcctcagattaattttcagcctattaaaacccccttagctatggtggttgatagctttatcagctggtaaaataagcatgagagtcctttaaacagaaaaagcaaagctggaaagtggccctcatctaccttctatgagctatctaaggcagagaaagtacagtcattgtttgctatgtcctttacttcctaaggatattcaagcaactctggaatctccttgtattgtgactgttttaaaatagacttaaactggacctttgcttaaaggtctgtttccctagcttgcaaggatagtctttcccattaataggaaggtattctgaacccctagtctaataagctcacatttgaacgcgcatggacttccttctacctaaactttcgaactttttttagacacaggaagtagcaagaagggagatgccaagtgacaatcaccaggaagatggtaaatattttgctcactgagtatttttcccccacactaatcagagaagtctggatgtgatgggatttgggagatgaagatgtctcaatatgggggccctatttagtcaactaatttctgcttttgtgagggactgtcctggatgattagtaacctgtgagacttttctgcttaaagagtgcatattctgacctcctttgttcttgattttttttgcgttggatgactattctttttgttacctttcttgccttcttttgtatttattattttttattcatccatttgtttctctctactggtttataagttatatacattttctatacttttagtattattccccaaatgataatatgtatccttaacttacataatttttaaattgttaataccttaagtcttcttttggataattcaaaaaccgtacagtactttatttcatttactctttcctgacttatatgttgttattatgaattttaattctctatatttttaaagacttcacaagatattattttttatatagtcagtgtagatttaaatctatccattaatttactactgtttgttcacttcctttttcttcccaggcttcccttctgatatcattttcctttgccttacagtggcacatactttaatgtaggtctattagtgatgagctctttcagcttttctttgtgtgataatgcctctatttcactatcattcttgaagggtattttagatgggtgtagatttctaggcagttcgttctctctctctcttcccacttccttctctctttttttttaattttttttatttttgagacaagttctcaatctgttgcccaggctggagtacagtacagtggcacaatcagagctcataataacctcaaacttctgggctcaagcaatcctcccacctcagcctcccaagtagttaggactaccaccacacctggctaattaaaaaaatttttttcggaccaggcacagtggctcatgcctgtaatcccagcattttgggagtccgaggcaggtggatcacctgaggtcaggagtttgagaccagcatggccaacatggtgaaactccatctctacaaaaaatacaaaaattagccgggcatggtggtgcttgcctataatctcagcactttgggaggccgaggcgggtggatcacttgaggtcaggagttggagaccagcctggccaacacggtgaaaccccatctctactaaaaatacaaaagctagctgggcatggtggcatgtgcctgtaatcccagttattcgggaggctgaggtacgagaatcgcttccctctgggaagcgaaggttgcactgagctgagattgcgccactgcactccagcctgggcgacagagtgagaccctgtctcaaaaaaaaaaaagaaacagaatttgtctccagaatgttatagattctttactgtttacacaaaagtcccacattttattggtggtggtggtgttccatgtggaagtcctttcatcactttatgctaccattgatcagaattataaaccacctcttcctgagaggtgtttctggcagacagagaatatgttcagtgaacagaggtactcccagctaggccacaaagaattcttatcatgttttgtttttttgccttggtggtgtttagagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcaggtaacagcttcctgtcagtttacaggtcttcttcataggcatgaagatagaagatataagtgaaaattttggaattaacccttctgaaattgtattagcatttcttaagttgtattttagggtcaccagtggttcttggaacctcgagaaatctgtagggtatgagtttaacatgatatatatattagggaaaatttgtaggaaagtgagcattgcagctacttgctattttagttaagcagcatcccaggacatctagtctttactcacagtcacttctattctgacttactttcagaagaagttagtttcaggctgggcacggtggctcatgcctgtaatcccagcactttgggaggctgagccgggtggatcacgaggtcaggagttcgacaccagcctggccaacatggtgaaaccccgtctctaccaaaaatacacacacacaaaatagctgagcatggtggcatgcgcctgtaatcccagctactcaggaggctgagaggcaggagaattgcttgaacctgggaggcagaggttgcagtaagccaagatcgggccactgcactccatgggcaacagagcaagactccatcttgaaaacaaaaacagaagttagtttcagagttagtgacagagatcactcttctgttacttatttattcaaccaaactcattgaacacctacagtgtcccagacactgttctagctctggagataaagtagcaaccaaaataaagttccatgtatattttaccataataagaagacagtccctactttcatagagcttacattctcatggggtaagacacatgataaacattttagcatgcaaatatatgtcaggttatggtaaatgctgtgaaaaaattatataagggcatagagcgtgataaggaggaggcgatgctttagatagaatggtccagaaagcttctctgatgaggcaccataaaagtagagacttgaatgaagtgggagtataagccatgtgggtctgggaggagaactttctagacagtgggaataaatgcaaaagtcctgaggctggaacatacttttcatgtacaaggaacctcagggaggccagtgcggcctcagcaaagaaagtagagtgtatagatgaagtaagaaagatgccagacttttttctgggtgagatcagaaggagttggagagtttgtagcaagggagtgatgtgatctcacttaagaattactgtgaatgttgggctgagaatagactatggggaggagggtagaaatttttttaaaatgctttggagagattggaatcagcgtaacagatgatgatggcttgggctagacagatagcggtggaggtggtgagaagtagtcagattctgaatatgttctgaagatgacactccatggtttgctgatggatccaggataaagtgtgggagaaagagggtcaatggtaattctgtggttttgagtctgaataactagaagaacagagctttcatttactaagatggaaaagaatgggaggtagagattttaagataaatatcaagagttgggttttggacatcttaagtttcaggtgccttattaaaactttccagagatgccaatttggtaattggacatactagtccagagtttagggaagaaggtatggctggaaatataaatttggagattataagtgtatgggtgacagtaaaactctgagactggatgaaatctcaccaaaagagtgaatatagatagaaaagagatctgaggactggtcctgagccctccaacaattagaagtagataaagagaaaccatcatggagagtgagaaagcagcagccagtaagatagaggggaaaaagccaagaggaagtaatatcctggaagccaagtgaagaatgtgtttcaagaaggagggagtgatcaatgctaggtcaaatgcttctcctgatagggagggagggagcctgggactgagaagtgattatggtatttggcaatgaagaagacattaatgaacagcttcaggggatgcatgagaatgaaagcctcactgaggtgaattcaagaaaaaaattggaagcaaggcagtaaagttactgaatatagacaacccttgtattagtctgttctcacactgctaataaagacatacccaagacagggtaatttataaaggaaagaggtttaattgactcacagttccacatggctggggaggcctcacaatcatggtggaaggtgaatgaggagcaaagtcacgtcttacatggtggcaggcaagagagcttgtgtaggggaactcccctttataaaaccatcagatctcgtgagacttactatcaccaagaacagcatgggaaagacccgcccccataattcagttacttcccaccaggtccctcccatgtcatgtgggaattatgggagctacaattcaagatgagatttgggtggggacacagccaacccatatcaaccccttcaaggagttttgcagtaaagggaagcagagaaatggaactagctggagaagggatggggtcaaggagatcctggtagaagtgatctagtagagggaaaactgatgatgccagggagaaaagggaccgttacaagaaaatggaatccagtccaccagtggagaggctggttttaaataaaagcacagatagttcatctattgtaataagaaggaaggcagagaatttattaatacagatacaggagagttggtagatttgatggtgtgatcatgtagatgttttctttgattgcctctcagggaaataaaggaggttggcacctgggtgtaaggagggaagagaaggtgttggaagtttgaagagagatgtgaaatatttgtctcagagaatagaagagtaaattggccagagtattatattaggagatgccgggcacagtggctcacacctgtaatcccagcactttgggaggccaaggccagcagatcacttgtggccaggagttcaagaccagcatggccaatatggtgaaaccccatctctactaaaaatacaaaaattagctgggcatggtgggtagacccagctactcgggaggctggggcaggagaatatcttgaactcaggaggcagaggttgcagtgagccgagattgtgccactgcactccaccctgggcaatcgagcgagactctctcaaaaaaaaaaaaaaaaaaaaaatcagaagaactgggcaccactaagggcgcagttacaatagtggtcatgagtttaaagtgagaaaggtcagaacagatgcgtttttttctccagctatgttcccctgctctggtgtaggcttggaacatgtggacggttagatttaaccagagttggagttttgtcagagagttgaggatgtatgctagggagtggttattatgacccttggactacaggcaaggtatggatagaagtgagacatgaggcagtcagagggcaggttcatctgttagcctgtttcctccacagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgaggcaagtgttggcttgtttgtgtttgtgcgagaaacaggtcaggttcgagaccagaatgagggttctgttgggaatggaggtggttctgaccaacagggctagaaattcaaagagattttcagaggctggtggctaatactgccaagctaacacctgttgagccttctgcccttgggaaagtcattcccccactgctgccattttctcacctatatcacagggagaactgtccctgatctacttccggctgaagattgaactctgtagcatctatgtttacagtctcatcatatttacacatttgcttcggccacacatgaaatagttcttataaaagcattgcttcaggctgggcacagtggcgcatgcctgtaatcccagcactttgggaggctgagtgggtggatcacctcaggtcaggagttcaagaccagccaggccaacatggcgaaaccccatctctactgaaaatacaaaaattagctgggtgtggtggcgcacgcctgtagtgccagctactctactcgggaggctgaggcaggagactcacttgaacccaggaggtggaggttgcagtgagccgagatcacgccactgcactccagcctgggtgacagagtgactcagtttcgtaaaaaataatagtaataaaagcattgctttgcttttctgtctagaagttaaaaggatttaaaatttttttccaatgtagaagcaaacagaagatgaattagattatccaagggatttttagttcagagaatgatttaaaaatcaagaaccattcccacataaacaatatacatgtaattcattttataaaatatcctagtggccaggcacggtggcttacatctgtaattccaccactttgggaggccgaggtgggcggatcacctgaggtcgggagttggagaccagcctgagcaacgtggagaaatcccatctctactaaaaatagaaaattagccgggcttggtggtacctgcctgtaatcccagctacttgggaggctgaggcaggagaatcacttgaacctgggaggcggaggttgtggtgagccgagatcgcgccattgcactccagcctaggcaacagagtgagactctgtctccaaaaaaaaaaaaataaaataaaataaaatatcctagtatgatagtgtcatacaataaaacttttatcattatcacttcttaacaagttttgctcctgcctttgcatacatcccttgtggagaatgccttctactctcctctcttgtctttttgaatgttcatttttctccaggttctacttccatcatgaggaagatccatccatgtggttagaggaaccccagctcttagagtcttctcttcccttgtacccaagaacctttgccataggaaccatttgtcaattaataatttactgccctgtaaggaagcaggagatttggtcaaaaacagccatttctagttacttatttttcagttgttggaaatcttacacattggggtgggtttacagggtttttgtttgtttgtttggagtgtttttttgtttttgttttctactgttaaagacttcctattcagttttcagaactttggaagtggctgtaatttttgtgcaccaaagggggcagtcttgtaatgttttatttagttttttggcctcttttcattctcagtcccctatgcctattttaccagacaagaacactaactgtgtgttactgtattcagagtgaagatccagcaacatttagcatatttgggatgttatattaatcagacatgctctaggaaattttttaacctctatttcatgttatattgttaaaatctggctagatgctgtggctcacacctgtaatcccaacactctgggaggccaaggtggaggattacttgaagccaggagtttaagatcatcctgggcaacataggagaccctctctctacaaaaaaaaataaataaacaaacaaataaataaatgttaaaatttcaatatgcttttctagacgatcttaaaagctcctttttttctgttagacattatttttctctttatggaaagctttaaaagagctgcttgaatataaataaaaaagaaatatactttttaatttctgaaaggtgtaagtcagaaaatttccaagaagagcattttttacattttttttttaaagccgggcatggaccgggcacagtggctcacacctgtaatcccagcactttgggaggcgaggcaggcagatcacctgaagtcaggagtttgagcccatcctggccaacacggtgaaaccccatctctactaaaaatacaaaaaattagctgggtgtggtgatgcacgcctgtagtcccagctacttaggaagctgaggtaggagaatcacttgaacctaggaggcagaggttgcaacaagccaagattgggccactgcactccagcctgggtgacagagcaagactctgtctcaaaaaaaaaaaaaaaaaaaaaaaagccaggcacggtggctcatgcctgtaatcccagcactttgcgaggccaaggcaggcagatcacttaggccaggagtttttgaccagcctggccaacttggcaaaacactgtctccactaaaaatacaaaaattagctgggcatggtggtgcacacctattatcccagctacttgggttgactgagtcatgagaattgcttgaacctgggaggcagaggttgcagtgaactgagatcatgcgactacagtccagcctgggcaatagagcaagactctatctcaaaaaataaataaacacataaataaaatatagaattagccaggcacggtggtgcacacctgtagttccagctattcgagaagctgggataggaggattgcttgaacccaggagttcaagactacagtgtgccaagatcacaccattgcactccagcctgggtacaaagctagaccctgtcttacataaaatattatagaatatttatgtttattatatattaatatattaaatataaccttagagtaattttttatattactcccatttgttttataaaatatactatttttaaaatgttctgcaatttaatatttctattatataacatattgaaccatagatgtaggtgtcaaacaacaaatttttaattttcttctgaaaatttctattattattttgtgacatagtcttgccctgttgcccaggcttgagagcagtggcacgatctcggctcactgcaacctctgcctcccgagtttaagcaattctcctgcctcatcctcctgagtagctgggattacaggctgcccaccatcatgcctggctaatttttgtgtttttagtacaggtaggatttcaccatattggccaggctggtctcgagctcctgagatcaaatgatctgcctgcctcggcctcccaaagtgctgggattacaggcatgagccaccgggcctggcctgaaaatttctattaaaaattatgatacaagatactgttacctttgatattatcctggaatatcttatgtttttgtcttagacataaataatattatgctactcaaatccaaactgaaagatgaaatcatctttttcactttttaaaaagtctaggccaggcacagtggctcacacctgtaatcccaacactttgggaagctgaggcgggacgatcacaaggtcaggagttggagaccagcctggccaatatggtgaaaccccatctctactaaaaatacaaaacttagccgggtgtggtggcacacgcctatcccagctacttgggaggctgaggcacaagaatcgcttgaacctgggaggcagagattgcagtgagcccagatcgcaccactgcactccagcctgggtgacagagcgagactccgtctccaaaaaaaaattaaaaaaaaaaaagtctcaatgtctaaattcttacttcctttattgtgtaagaatgacaaatggttgggttttttgtttgtttgtttttgcttttttttttctcttgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtgagtgaatgcattctctgtccttggacaggagttggacttttcctctgctctgtgttctgctaaaagccacttagctctcttcacttgcaaggaaagttgttctcatgatcacatcctgaaacatctcagaaacatcatagttaacaaatctacatttttctcatattctacattattttttaaaagcagcacctcttctaattattttataatgattgttttgttcctcctgtaaatatttgctagtctttggtaatatatagagtaaccagatatgtaaattagtgactatattaatttttttaaagattttgtgatccttgggaaagtgccaataatgaatacaacagaaattgggtttgatcatcagagttttgagatgactgttagaatgttatgatttgaaaatctcgaatgagtaaatgacctggactccctttaggggttcgttctttagaaacatgggagaaaacagttttgcaaatgttggcttcatgcatttatttgttgttattttctttttgatccttaacatgtttgttggctatttaatagaagaataattaaggaaatttcgttggtggtaaaattttaaatataaactagaaacttggctggatgcggtgactaacgcctgtaatcccagcactttgggaggccgaggtgggtggatcatgaggtcaggagttcgacaccagcctggccaacatggtgaaaccctgtccctactaaaaatacacaaattagccaggcgtagtggtgtgcgcctgtaatcccagctactggggaggctgaggcgggagagctgcttgaacccaggaggtggagtttgcagtgatccgagatcacaccatggcactccagcctgggcaacagagcaagactccgtctcggaaaacaaacaaacaaatgaaaaaaacaaaaaaactagaaacttaaacgttgtttggggttaaaaaaactttttaaaaaatatctaaagggacatacagaagaagaaatcctaacacagttattttccttctcatgttgacctattgctcccattttgtaggaaattatccccagggccactaatcaatgactaaggaattatgcactcacaaggggctgctgttgtttctccatagaggatgtaggatataatttcttgtcctcttaaaaacacctctttctgccacttactaagttctggtaaaaaggagataatacattagcctatttgatccagagagctggtagttactgactaggaatgctgtgccttagcttttaagattggcctgtgtgcccatcctgaatttttggcaggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggtatgcccctctcatctccctttagaaaaggacagagcagcagaactacaacatctctgccttaatgatcagcatcaccgtgaacacctaaccaaaatatggcaaaagtctgggcacagcaggaatacaaaacttgctaggacagggacaacttggaagttctgcagggatgactccctcatcctaaccctaatccaaaaattctaaagaaagacttgaaataagaagaaacaaacaaaaattccaaaaaatagctctagagtggaaatgtttaggataatgttcttgaaggttatggtttcaccccagcaaatgtatctgggattgtctttcctcccttctaagcgagctgagagccctgaaccaggggctaagggccattctagagcatcagcctgctggctctaggaaaggaagaagcaactcatatccccatgctttgttcccttttctcttttcttttcttttcttttcatgaggcagagtcttgctctgttacccagcctcgagcgcagtggcacgatctcggctcactgcaacctctgccccccaggttcaagcaattcttcctgcctcagcctcccaagtagctgggattacaggtgcccaccaccatgcccagctaatttttgtatttctagtagagacagggtttcgccatgttggccgaggtggtctcaaactcctgaccttaggtgatccacccaccttagcctcccaaagtgctgggattacaggcatgagccactgcacctggccgccttttttcttcttttttttgagatggggtcttgttctgtcactcaggctgaagtgcaatggtgcgatctcggctcactgcaagctccgcctcccgggttcaagcgattctcctgcctcagcctcccaagttgctaggactacaggcacacgccaccatgcccagctaatttttgtatttttagtagagacaaggtttcaccatgttggccaggatggtctcaatctcttgacttcatgatccgcctgcctcagcctcccaaagtgctgcaattacaggcctgagccactgcacccggcctcagccgccttttcttaacattagaggattttcagacaccaagttcagttctagaaactttagatagatcactaagaatgctggccatttgtcaaaatgacaaatgtttgttctgcaagagtagtagataactcataagaaagattgctagtccatgtaataaatttgtttactgcttttgagctgtatttaccaatgaattaaaattctagtgagaaagagatgctgacttccaatcagtttatcactaaatagaggaaaagatctttcagttctctaaacacaccttagcatgtcagattcttttttttttttttttttttttgagacggattctcgctctgttgcccaggctggagtgcaatggcactttctcagctcactgcaacctccgcctcccaggttcaagcaattctcctgtctcagcctcccgagtagctggggttacgggtgcacaccaccatgcctggctaattttttgtattttagtagagacggggtttcaccgtgttgcccaggctggtctcgaactcctgagctcaggcaaaccatccacctcagcctcccaaagtgctaggattacaggcgtgagccacggcacccagcctagaatgtcagattcttaatgtatttgtattttgttttctaatctaaaggaaagtttgaagcaaaaactggtcagagtgctggaggaaaacctcattttgtcagaaaaaattcaacagttggaggaaggtgctgccatctcaattgtgagtgggcaacagtcacatacttatggtaagttgaggaaagccatgatatatgaggcctctcaagacaactgtttgtttatagatgacccatttagtaaccttcatcatgctagctcacgtggctgcctttggcctacttggtcatcagttttcctggcagttaacagaaacaatcatcttgcctcagagaattgtaatgcaggtggcttgagttaccagatgaagctcttgtcagtggaaagcatgtacaaatgttgttactattgccattaattttgagaatgacacatgcttttgtgattataacaccaagaacatgttctttatacaaagtttggaaaatacaaggaaaatataaccccatgatccagcaataacttccattagtgtttttggtatattttcttctaccatacctctctatatttttaactccaaatttacaattgtggctgggcaggtgcagtggctcacacctgcaatcccagcactttgggaggacaaagcaggaggattgactgagtccaggagttgagaccagtctgggaaacatagtgagaatccgtctttacaaaaaataagaaattagccaggcatagtggtgtgcacctatagagccaaagaggctgaggcagaaggatcacttgagcccagcagttcaaggttagagtaagccttgatcatgccactgcaatccagcctgggtgaaagagagaccctgtctcaagaaaaataataataaaaataggccgggtgcagtggctcattcctgtaatcccagcactttgggaggccaacgtgggcggatcacttgagctcaggagttcaagaccagcctggccaacatggtgaaaccctgtctctactaaaaatacaaaaattagctgcgcgtggtggcaagtccctgtaatcccagctactcgggaggctgaggtagcagaattgcttgaacccaggaggcagaggttgcaatgagctgagcactccagcctaggcaacagagcaagactccctctcaaaaaataataataataaaactgtgtcctggttttaaaaaataatttacatataattagatgcacacattttaagtttgatctcaatcaaaatacagaacatttctagaaagtttcttcataccttcgtgtagtcagtttcccctactcttgacctcaagtaatcacagacctgatttctacatcctaatgttattaatttcatagtgtaggcatttctacagtatcacaagaatataccatatttatctattttgtcctctatatagttgtttttataatggttatataatatttagaataaaatgattttaaattatttctaaacattcaaaagaaagacctgaagtgaaggaaaagaccctagaatcaaatgcttttctgagattaaccttcttcccttttgatggagctgagagtcctaatatttaatatttatactattataaataatgctgctattaatgtctatgtacagaaatctttgtgtacatttcagactattttcctaggagacagtcctagaagtagaattagtgagtcaaaggatgggatatttttgaggcttttgttacataaatcactcccaagaaaattgtttcagtttactcccacctcagcagtgtacttgaatgcccctttcactcccctctgccaacactgggcattttttcaaattttgccattgtgataagtgaaaaataatatcctttttaaatcttgattgtactactttattatcagcatagtttaggccagtatgttagataaagtttgcgcttgacagactagcttagcacccctaagcaaattatgggtacatggatttatacaaggaacttgatttcaaagttctgatgtggaagcactgaatttccattgttaaatctcagcactaaataaataaataattctcagcactatctgatactcacaggcccgaataatcaagatatcagtctccacttacctactttgaaattaaaagtaggtatttgtccactagatacttactttcattcagccaggaggcccagtatagtattttggcttactggtgataaataagcttttgcagccttgttttccaccttctagaactctcctactcaagatgtgatccacattagtatcacctgggagcttgctaaacaagtggggcctcacctcagacctactgcattaaaatctatttttagcaagatccccaggtgatttgtaagcatattacagtttaaggctgggcacagtggctcacgcctgtaatcccaacactttgggaggctggggtgggtggatcacctgaggtcaggagtttgagaccagcctggcaaacatggtgaaaccccatctctactaaaaatacaaaaattagcagggcgtggtggcatgtgcctataatcccagctactcaggaggctgaagcaggagaattgcttgaacccaggaggtggaggttgcagtgagctgagatcccgccattgcacttcagccagcctgggcaacaagaacaaaactctgcctcagaaaaaaaaaaaaaaaaaaaaaaaagtttaagtatagaagattggcatcattacaaccggagttcctcttcttttacctccttattattgcaggtaatggtagtatattggggaagctaggtataagtgtcttagccacaaattcagtttctacaagtattaattgagttattactgtgtgcctgacaccattctagatgttttcacatactacgtagggagtgaaggatgtacaaaacaaactaaaatggagaatacggtgtgagacccaatatctattgactgcctatgctaagtgagggtaggtgtctcattgaatcctcataacagggctaaggggcagggttattagctctaatgaaagtcagaaaaatgaaccaacatgtgcaatatttttttttttgagacggagtctcactctgttgcccaggctggagtgcagtggcacaatctgtgctcactgctacctccatcccatctcctgggttcaagcgattctctgcctcagcctctcgagcagctggaattacaggtgcccaccaccacacccagctaattgtcgtatttttaggagagacggggtttcaccatcttggccaggctggtcctgaactcctgaccttgtgatccacccgcctcagcctcccaaagtgctgggattacaggcgtgagccaccgtgcctggcccacgtgcaatattaagtggctgaattttaactcatatctgttgccaaaccctgtattcttgccaccatatctcctatctccaagtaaggcaatggagtgtgaagttgggtgccatggggcccccagttctcaagatgtccatctgaatacttatattctgctcaaagactagcagcttggaatccttttcacccctggctactgtgccctttgtagatgatcttctgcacaaaaaccaacagctgaccatgcaggtggcttgcctgaaccaggagcttgcccagctgaaaaagctggagaagacagttgccattctccatgaaagtcagaggtaggagagggtctatctagcttgcttctagaagcagatatttactccttttatctcctttgttttgcttggaaagttaatatctatgcactttgcaagtgaactccattctgtgtgtaaacctcctgtatctggccagttagctcagggattataaaaattactgcttcccaggacacatcagggactaatcgtctttgttggcattggtgggttgcaacacctcgataattagcttctcactggatctgatgggacctttgtttgggtcagctaacttttttgggaggtcagtacatacccctaaagtcggccatctggctcctctggaaagtgcctgctattggtcacgaaagacatcaagagcacttggcagggagtgataaagaactcaaagtgcgttgtttccttcagaggagctcaacagcatcagtccttaaagaacagcacccccggctgggtgtggtggctcacgcctgtaatcccagcactttgggaggccgaggcaggtggatcacgaggtcaagagatcgagaccatcctggccaacgtggtgaaactccgtctctactaaaaataaaaaaattagctgggagcttgctaaacaagtggggcctcacctcagacctactgcattaaaatctacttttagcaagatccccaggtgatttgtaagcatattaaagtttaaggcgcgtgcctgtagtcccagttactggggagactgagacaggaggatcacttgatcttgggaggcggagatagcagcaagccgagatcgcgccattgctctccagcctgtcaacagagcgaggctccgtctcaaaaaaaaaaaaaaaaaaaaaaaaagcaaccccaggatacaggcaaggcaaaaaaaatcagaagagacttcaagactatggctacatttagagaagcccttgagattttggcttgccgataatacacatttacgaggactttcactgcagtttaaatataagcactccatccccaaaccttcaagccttctacttcacttcctgattttcatttggttaactttatattcagaggattagacccagaaccattctggatttgtctgaaaagcttttcattataattatttcaaacattacaaaagtaaagaggatagcataatacagttctcaaacttgggtatgcctccaaattaactcgaaggacgtgttgaaatgcagattgctgggcctcatcccacagtttctgagtcagcaggtctgggttgggaactgaacatctgcatttctaattagcttctgggtgatgctattgctactggtctggggaccacactttgaaaacattaggatatattgctttagtgacgtacagtcaaaatactctcttttaaattaaccagaaataatccttctgaaaccatacaggttcatttgttttattttgcccttgattcttagggaattttaaaaataattttgatttaatcttgttttcataattatgtaaaacatttacacagtcccaatgtcaactctatgaaataagataaatccagaaaaatccagcttcctttcctgtctttgctgtcctttccttccctcccaccatccttctattgtaggtgtgggtgtatatttgtattccctaattattacataagaagactcagtgttgctttaacatttcatcttgaaaatgcattcatagtggtgtatagagttagttctcattcctttttctagctgcatagtgctcagttgtgtggatgatataccacttatttaattagtcttctattgatggacatttagtttaacatattttgccattaaaaatagtgctataatgaatagtatcgtgcatacatttttttctttttgccagtgtgtggatggcttttaacattagatggtaatacaggccaggtgcagtggctcgagcctgtaatccacactttgggaggctgagacaggtggatcacttgaggtcaggagtttgagaccaacctgaccaacatggtgaaaccttgtctctactaaaaatacaaaattagctgagtgtggtggtgcacacctgtaatcccagctacttgggaggctgaggcaggagaattgcttgaatccaggaggcagaggttgcagtgagccaagatcccaccattgcactctagcctgggcaacaaaagtgaaactctatctcgaaaaaaaaaattagatggtaatacagagttcaatgcagccatgactagcaccattagtgaattgcagtggcaggatagattagaagtagatgttatgatttggggtagaaattggaggcctgatcaggtgccagtgacccaaggcttctacttacctcatcatcaaagtgcttttgaaagaacagaacaaccgctagctatatataaaatgggaaatgtattattgcttcagtaagtctggaatataatcaaacagaattgtaatgaagaaactttaagtctgcttttaaaataactcaatcataaattggacagttccttctatttaaagatgtgacttcatttcacatttgcctttgggagacattttgggtctgcatggtatctctcttgcttttatgatttcatgactgcctttttcccttgggcctcagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctgattagattgtattggtccttctttttatatctctatttatctccccctgttgagtcattctttccttctgcccacagaaatagttggcacttggtcccagctattgtatagacattgcatagagacatttggctgaaaatgttgaaagggaaaaaaacactagacatttttcccctgtgtcatttgaaactgtgtggtagaaagttaaaaaagaacatccgccagattcatcaaacagggtttgattacctcccgccatggtgaaaagctgacaacacctggtgtctgccctggagcagccaacaatttagtcagggaaaaaagcaaactcatgtgatggggcccaaagcttcgaattggtactaaatagatctaaacaaaagcctaaagatgccctgaagagagagaaagagtgagtaatggccactgtaggattggaggtgtcagtgaggcttgtttgaatggatgctgcagaatgagtaagaacggtagcaggtagaggggatgcagagcctcccaggccaagagtacacagaagagtctggaacaccacagggggatagtggggcagggatagaagtgttggacatggaagaggtgtaatgtcatgagaatgtccccagagcaagtgatctttcatgaagggggagacatgaagaggttactaggcaaagcatgtggctgagggcaagagcaatggggagaagctgcagagagcagcagcatgtgcgaaggccgggaaatggaaagggacgtggtttcttcagggagctgaggggctgagaggaggtaagcaggagcaaggttgcaccactctttgaagattttagattgggaaggcagaggagtgacagactgtgtttgaaaagctttctcaggaccaggcataggggctcacacctgtaatcccagtacttagggagatcgaggcgggaggattgcttgagaccagcctgggcaacatagtgagactccgtctctacaaaaaaattttaaaagttaaggcgcagtggtgcatgcctgtgggcccaattactagggaggttgaggcatgaggatcacttgagcccaagagttcaaggctgcagtgagctatgattgcaccactgcactccagcctgggcaacagagcaaaaccctgtctccaaaaaaaaaaaaaagaagaagaaagaagaagaagcaggaggagagaagaagagaatgggttgatcatgtgtgaagtagcgggggaccaaagcggagctaggcagcccaaagaagaggcagaggcaggccggactagatatgctgcttctgaatatgttagctttgggctcagcatccagtttacatgcaggtgccctgtacttttaatcctgattgggcatttgaaaaatcaatggggaaagatgatgtaagtggttctaggtatgtttctgcttcagtggcctcccagcgtgctaatgttgccagagagtgtgtagaaagtgaaggattttcaacctaatgccacatggttcttctcttcaccttcagggccacatcagagagagagacaggtggaaggattagataatttacttgtacccctgattccatgctgtgcagggaaggagagccaccaccatactaataagacatgacagtcacaagtttctaagttataaatccacagacttctggattttaagtggcttcccaaaagcagcttgtacagaggagccagaagtttctttgagctgcaaggctctgagggagctagagcgagcttgtgctctgtggaaatgtcagtaagagcagcctccctgcacccccgctgcctctttcctgggcctgtctttgtctcccaggtaggggagcatcagccagtggccttgcatccctgagttgttatatttcagggtctcagcccagtgcacaggccaacctaatggacacaccagggggcagggaggaataatgcactgctttcctccaacccagcccttcctgcctcctccatgaacacctgatggtgctagccccagaatccactcaggacacctcctaaggggaacaaagagcctggcccagtgtgtgccaccctccaccccatttgccattgtcattgaaagtgaccgaccctgccccaggccaggcacctgctaggtttgctggccactcctggggaagtcatctgtttctgatttttccctgtatggcacttgttctacagggcacgggtaggggttgcgatgttaaggagagagccaaagagctcagggcaaactggactcaacatggaaagcggaggaccctttaaacaagcagaaaacacgtggagcagaatcccacaccctaggcctggcactaccaccagaaagcaggacaggtctgggatggagactggtcctcagggaggttctatgtccagagggaggggcagagccactcttaggttgggagttctcccagccatacagagcaggttttaaaggctctgtccctctgatcctaacctctcctttgtctaacctgattttgctagcaagggtatccaaagctttcaaccacaaggaggctgttaggggaggggcagtggcattgctgggcaatggctgtcatgtgccagattctgctagacccgtctggtcttagggtcctcccagccctgagtgggccttaaattccctcgggcttcataacggcatttcgagaagaggcggctttactcctatgacgtggggttttggggctcagccattctctctgtgttcttccaagccatactgccagtcacaggaatggagaagccgctgggccctctaccattggatggtactgtcacctgcagtggaatagtgggagcctggcccaatttggaacacagttaaatttgtttccctgtgaggctgttctggtgaaagccagaggatttgggtttcactcctattatgttcattttaagcttgcaattcaaacgaattttccagggctagaggaattgttcctctgcattttttttttttcattaaacgccttgcattctacctcttaacatttgctggtgggaggatctgcctgaaggtccctgaagctcttccctgggccactcaaggagacgcggtcagctgggtcaggaggagccgcgctgtgaggcaaggctctgctgtggccaggtgcccacctgctgcctgccgattcccgcctgacatccctgtctcaagccatactattccgctacacccctgtccccaaggaaagctgggcttaagggatgtggggccacctgggcaggagcatcccccaatagactgtgggatgagaggataaacaatggtgctgctttgtcttgtgatctgggtcaggaaagcaggcatttgggaactggcccttttataccttttctagcccctttgggagccaccctctcctgggtaggccctaaagtcccatccagccccattttcacagcaaggaaggaaggagaggtagcccgaaagccttggcttgggaatagctctgtcaaaacacccagagcctcagtgagatgatctggaaacgcccaggcatcctcaggaccagagaggctcccttcccccactagggatgtggaacagatgggaggacatcaaagaggaggcccctttactgagggatgccctgctcccaccacaggctagtgttgggtgccaagccctatcaccagtcagccagtcccagttttggaagtcaatgctggggcttgctagaaagagcctggcctgggaggcaagaggcatggtctggcctctagtctgcagaagcccctccacctctctggatgtttcctcagctataaaattacggagtcagatgagctactctctttttttttttttttttttttttttttttttgagacaaagtgtctgttgcccacactggagtgcagtggcgtgatctcggctcacagcaacctccaactcctggattcaagcgattctcctgcctcagtctcctgagtagctgggagggactacaggcacgcaacaccatgcccagccaatttttgtatttttaatcgagacggggtatcactatgttggtcaggctggtcttgaactcctgacctcatgatccacccgcctcagcctcccaaagtgctgggattacaggcgtgagccaccgcgcccggcctggatgagctactctctaaggttctgcctggccctgcgttttctgtattctgagccagaacccaaaatgacttgcctcggtagcccctgttcgcagactgaaagctgatgcctggctctggggcctctgccaatgcttggcccaggctgagtcggctgtttcatccctcctactgctgtgaaagtggagagggggccaactctccaaacccaaggcactggtcacaggaaggcaagctttgatgtcaggactcccgtcaggcccagctaaaaggctttggacttccccaggagtctcctcagacagaatggctctgtgctaacagaaggggactcatgagtgcctttttctgggcaaggctgccaggggaaggggagtgattagcagtgtgtggcatgcagcggggtgatgacactgagggggtcactggagtgtgaatgtcattcccccatcatcgtcaaccaggccatattggtacaaaaggtgtctttattgaggtctgggttaaaattaggcacttggccagagcagcagcttaaatatgaggcaagcagtcaggggttagccatgcctggggctgggttggggtcatgaggctacaggcacagactgtccccaggtggacagaagttggagcaggaagaggaggaggaaggggccgcagagcagcctgggtcagaggcctggtgggccagcccagtgggactaggcaggaagctctgggtggcaggtccagcagggaggggaccaggatctcttgctccacgtgccccttagacccaggcctgagcctctggcaggggcagccgcacttggcagggcggtcttcccaagcctcacttcttcaccttggcatcgtaggtgcctgcattcttgtaggcgctcacgtagccactgtcgtccaggatgtcctgccgtcccgcaatgcccttgcccttgccgctctcatcgaagcgctccttgtgggagcccgtgtatctgctggtgtccgtcagccggtctacagcaccccctgtttttgctttctgtttggacagagtttccccaggggcacctgatgagggagcccagcccttcccacccacagccacgattccccacaccccattccgtggccacccgagaccagcagggcacttacagtgacgcccacattggctggctctttgcctgccaccagctggcagatggcatcgaaggcctcctccttgctcttccccttgaatctcttggtcgccagctcttccagggccttcttgaactcctcatagttgatgacccgagcagacttccccctgacaggcatgtgggcaccatgagggttcccctttcttttttctcccccaggggaaagctcaaacacatttgctgccaccacaaattatgcaattgcgtttctttcccacgtttggggaagtcgcaggggtcagcaactctggagggcaatagatataaggtttgccctggaagaacgaccttcgtgatcatggtgtttccctgaccccttcttgatgtcctccctggttccagccccccagttccccacctcctgggaacatgagaagcaggggctgcttagggctcacttgactttggagaagacgatgtccacatcggtccctgtcacggactttccgtcagccaccttgcagtccttgcacagcttggcccagttcttgccattcatctcttgcccactggccttggggtcaccatggatggcaaacttgcggaagctctcctccagcccagccatgtctgtgctcgctgccatgccaccctatagagacccacctgggtcatctcccagccaatctgcccttcccctcccccaagcccagaacatcccagcctctacctcaaacctgcaagacctgggcaggttctgctacagagttggtgctggagctgcctggggagaggggcccgtcactgtcgccctgggccacagagccccaaggaagagccccgggaggcacggtcttgtcactaatgccagccctggctctcagcagggttcagcagatgaaataatgatgcccacagggaacagagtggcactgtccagaaagactgttagggcagcagctggggccctggctttgtctggccctggcacaaggccttgcttgggtggaagtgagggtggcagagcaggccccctccctggaagctccatgccaagctggcttggggccaggccaggctgctggtcgggcaggcattcagtgaggacagcatctctgtaagggtcatgaggacccagcaagagccagtctgggcacgggtgcatgccctgggcaggggtgcagctggtccagcaaggccttgttactatttgctgttaaacaaaaacatgaggggagcttggggctggcctggccacagtttgtgaagcctggagacggttgctaagggagggtggtgctgcttggagaatgttgctaagggcaggatggtgtcagggcagctcagggagaagctcccagtgctgaggggctgggctgggctgggaagctggggcccacgggtggggcacgccagcactccctgcgcctagggcataaccgtggcttcctggccccttgccaccgactggtgctgtaacctcccactgtggagttttgggggagcaggaggttgggggctagtagcgtgggggctgtagagttacgaaccccaagagtcgtgctggcaagtggggctgtggctgaaacacacttcatcatgtctacacctcagacctcccctggccacgccctgaacttggccacaccagcccacattcccagcgaccctgtgcactcagccctggcctgccaccccctgggccttgtacccctggccataccttcagccctccatcctccatcttcacacccacagccacagccctcggccaccagcccccacatatatactaacaagcctgcgccaaccccagtaatacccacagtccagcactaaagtgccccccacacccacagccctccgctgcagacccctggccacaccctgagcctacacagcagccttctccatccccacacccgcagccctggggctgaggcccctggccacaaacctgcatcccttcctgagacccctgaccatagcctcagccactcaccccctccaatacccgcagccctttatcaaggcgccctgaccctcagcacccctttgtccacacaccctcagccctctggccacaccctcagcctgcactgaaggccccagtccacatccacacactaacattataagactcccaggtactatgcggagatcccctgcgtagagacctccccaccacatccccctcctccactgccacctcctgaccacaccctcggtctcagcaaccatcttctagctctgccttttacactagggcttccagtgaccacggcctgggctctgcccggctgccccatcttccaccaaaaactcctcgccagtgaccacactcccatccctaagtggcagtttctgggactgtgagcaccggtggttcctacgttacagggaccataaccccagtccacgctgcactccccttccctttccctgggtgcaacctcccaccagggaccccaagacccgcacttggttcaccaagggtaacgtccaggggagcttggatgccacagggtgcttggcccaagcactgggcggatcctgcgtgcagtgctcactcctgtccgtggaaagatggattcttggtcatctcagcgcggtcaggtggcgctgggttgcaggccgcagccccatgggtctgcaggccatggatggagtggccacacccgtgaactggagccacccgtcccgctcccactgggacagctggagtcatcaatcagccggaccaggaggtgggggctgcgaggtggaatgcttggggccagggcagggccgctcagctggctcctcggctgggaccgccggaggttgggaccctttccaggctgctccccccaaccctcatcgtgcaggatactgattggggtggcgggcatctgggtctcctatgggcttctacctcgcggctgctcctgaagtgtgcgttcggaaggacagaacgacgcaggaatggaccgatggacgcgggagaccaggcggctccgcagctccgctccctgccggctcccgggtgggactgcagcccaggcggctccgccgtattatcccctgtttctcggtctccatagagacggcgagtcccacccccgaggctgtctcggcgggagagtgaccaaggtcacgccggccccgcccacgaggccccgccctccccgagactctccgggagccgcatcccgcccctcccccgcaactccgcggtcctcgcgacggcgagaccagcgctctgcagttcggggcgtcttcggacggccccctgaggaaacagcctcccatcctgggatgtgcctaaagctctaagcggccccaatctccagaagagatccagctccccagagagtcaaccagaggccactggggagctgcgcggggcattggtggggcttggggaatcgggaaggagctctccctcagtgacaggggtatacggttgactcaagagcactgccatccactgaacggatggcacccccaggccacaactcccgtgctctcttgggtaggattcagagcctggagcagtggggaagaagggaggggactccctacgagcgaatcgcgctcgcccagccccaggatgctggcattcgacggcagccctgctgccggggaaaagctgcgggacctcctggctcggccccctcctttcgccgccacctccccacggcctcgcagcctcagcgcccactgctgctttcggagcccaaagcctgctttctctcggcctcccagtgcaaagcccatctttaagaaaaataacctcctccaggccgccttctaaggcctttcctaaccacgagccgcacgtgagcacctccacagggcagcctgggtggctacctactatacagggacctcctccccgcccccggtccactggccagggtcgggcttctggatggcccgtggcccctgccattaagaaagtaagcgcgacgtccgcaaaagcataaaaaagtttattggagcatcacagccggtggggcgggtattgctgagtcgtgggggagggaggccgatcccgccggccgtaggggcccctaaagtgcactcggtgcggcaaggatggggtgttgcatagagagtcaggccggccgctctaactcggccctccggcctctcggcccagctaagccagaccagcctcccggccgcccggcgccctgggctcgccgctgctcgggctcacgaaaacggcgggcgcacgcgcctgccgcgccagcgtgggctgtcggccccggccccgcggggcggccagagcggcgctgcccaggcgcgtctgcgccactggaatctcgtccacggactctgccgacgccgagtggtaggcgccggcagggccagcggcgtgcacagggctggcgtccgcggaatccgtcgacgagctggagcggcggctgggggccctaggccctgcgcaagggaagggaacatgagcccagtggctgcggctcgcttgtggctctgccttcccctccctcgagttcccagagcaggacccggacagggagaggcgctcacccgacgccggatccgaggtctcagacgttcgcactttatacacgcgcctcttcctctttttctgcagagacacgggggagcctgagggccccacatcgccaaaagaagcagaggcgagcgccagggtagaggcttctttctatcccactccacctggaccggaggcccagcacagtccctcctacctggggtcggatccggggaggcagggcgagagtgtctggggaagagggtggtggaggttccgcttggccacgggtggcaagaaactgggagggactgagggggaagcaggagggtaagcctggggcctgttccccaaatccctccccactggaggtgctgagagaagcttcccttcctgttagctcagagaagggcctgacccatgccccgaccttagcctacccccttctcctgcctcgatggccctgccatgctaactggagatgcccagtggcacatgcccaggttgcactcacttggcattcactgctgctggcccggcctggccagggggctctgggcgcatatgtctgaaggtccgcatgtagaactccatctcctggggaaggtggaagtcaaggaggctgggaggccaggtgtggctcccgagcctgctgagccctaagcccacgcagtcctgccctcattggcctctgtgggatatctcaggcctcatgccaggctcccagccatgctgggaaaaccccatctgtagggtaaggcttaaaacacccatttctggcccttgccccatccccaggtccttacctcatctattcagcctctgcctcctgcaggaaggctcccagcccccatgggtctataggcccagtttagagaggctcagccagggagtggtgggaagctcagagctgcccgcacctgctcctggtgtccccagggatccagcctctgaaccaattgttttcccctggctgagaaacaggcctgagtgtgcatccaccagctcccgcagagctgagtcctgggcacacccctcgccctcacagaggaccagccacgatccaggctgccgagaaggggctgcgtaaatgcacatgcggtggtctccctgccactacaccaaaagggaaggtagcaggtggtggaacaaacagagccgcagccccactgagcaccaggcttatgggcaagccctgatcttcacagcaaccctgagggtgcagacgcgacccctgagagcaaaggggccttgaggccagggggttgcaggagtggcctagtcctgcacccccgcccgcaggactcgccccagctttgcccagaaggactccaggtgaggaaacaaaagcctggggaaagcaggcccgggaagggcgtggtgcgagatgggggcgggtcccgggcggggtgggagccgggaggggttgccgggagcacccggacagctgtcgccagttcagcagccgtttccatggagacggaggcgtcctgactaatgcagagaggacactgtaacagcaaggccgtctctaaaacaagcctatgtttgggggcaacggctccagagaggggcccctcccgcattcctgctggggtgggggtgggtggctgcctgcagggccctgacagatctgggggaggagcccagccagcggccccgcccaacctctgccctggctgctgctctggagaggggtgtgggggcgccagcctgggccgaggagcgcggggtcaggggtcagaggccagtcacagggactggaaacctcaagatcactctcccccacacctcttttctgccccagtgtggactcagtgaccctctagggccagcagaggggcaaagcccactggggggccctgggctccagaggggggagcagaggaggggccagcagtagaggaggtctcagaagctgaggggcctggatgggaaaggcgccaggccctagccagctcaagaagtctgaaagcgtccccagtgagtccccactcagagccctgtcctctctcgccatggctgtccagaggatactgtctcagagaccttcaaaaccgtgtacattcctgaatggtactgggccctcagcctcagctctctgctttgtaaaagaggacaagaacaccactcctgtcccccgggtttgcctccctcaagtcactgcagatggacagaacagaaattaaatgtcttcgctgtggccacatttggccccaaagccttggcagcgcagggccaaagagcccgccctgcttcagtgggtgctgcctatgaggcttgagaaagtctcctgcctacttctctgggcctccgtctcctcttgatgtggggctggaaacagtaccctctccccagcacagctgccaccatcagagcccagcactggggcaggtatacggtggtgtaacagtggagtcgccacccacagccagcatgccccaggcccaggcctgcccagtcctggcagcctggcccacaagtagtgtccagccctggtgacaagaacagaagaggtggggtcctaggccctccccaacccacccaccagcctctgtttgtgtccagttgccatgaggcctcgggatccagggctcagccttcccccagcaaagcctgcccgggccccgccttcctagtccctaggggctcctttgacgactggatcacccccaccccagcggctgacctcaggaagccatggggcgtgggaatggggataggctggtcagccactggcctggccaggccggccagagcgtagagaccttaactcttcccagacccagcttgtggttaaccttctaggcctcagtaggcacatctgcagaagaggctgttctaagcataaattagggtaatgggtataagcgctcaaggtcatggatgaggagaagtgatggctccatcctggccacccatcactgaccccgtcgctggtccatccctctctctcctgctgcagccccaacctgcttgcttccaggctcccacatcccatgccctcccgcgcatgcttggcgcctgggcaggtgtgtacgtggggtccgggaaacacagggctccctctggctgtgcccacgcttgggcgagcaggcacacgctcagcacaagcccggtccctgctgcccccagcggctgttccaggcttgcctcccttgccctgtctcctcactggctgctcgctgcacagcccaacaccccccacacccaggccccctcccacccttcatcctctatacctgaatgggccgcatcttgggaggacatgactcgagctccctgtgaacccccttggcctcctgtggtgggcggtgctgcacgatgtactcataggtggtgagcttgtgccacactggtggggggaggagagggctcagtgcggtggaagggggactctggagctcagaacaggagggaggacaaccagccccaggctgaaaccagtgtccccaaatacacgaagccatcaggtgagacctggccaccatagtgagcccatactaggcaggggcatggtttcagggtccaccgtccaactgggcaccttcctgcaatctgaggacccctgcgttccagaaggcaggtgcaggaggcacttactgagataaatgtggaagcagagcaggtgccccaggagggctgtggacaggaggcccagaaggatgagcagggcggccagggccaggatggcaggggcctgggtctccacgggggcggcaggcaggaacacgaaccacacatccgtgtgattcttcaggactgcaaggcacaggcagtgtgtgctcagccggggacgtgacgggtgaccagggttgggggtgagaataggcccggagcctaaactgaccttcaaagtgtcggttggtgcgcagacgcatggggttgacaaagaactccacgaagacatatgtggccaccagcaccaggagcaggacgcccagtaaagcggatgcaacactgtgtagaaagagcctgggcccagccatgggtcgctgtcagctccccggagctccagcctcagaaggcccataggagttggggctgtagggtcattgctatgggctcagagggctgagggtgaccccacagccccaactcctcagaagccaaaggcatacggcaaaactgaagatgggtggccaccccatcaggcagcccacatttctctgggccagcttggtggaagattccaggcccacccttggccatctcagccggcacccaggagcatcactctctctgggcagcacccccgcataaaacgggcacaggtcctcgaagcatccccatccccgcccgcctgccatgcgagctgcaaggtctgtggctcccaccctcagacagtgcatccccaggcccgcgtgcggccgggctgtcctcaccggtagttccgctcgcccacacagttgttgagccacttgcagtggtggtcgaaaccgcacacgcacttgttgcaggcgctgcagtgcttggagcgagcgctcctgcagggagagggggcacagcgcgattggccggctcattccccgctctgcggcccggccggtcggggtggttgagtggggtctgtggagggaccaagcgccaggcctgagacagccccgagcgaggcgacgaggagcgcgcgcgccctctgcaggcgctgcggggtgggtcccctggaggaggcagcgctcccgaagagctgggggaccccagaggccgcaggaggggtaaggaggtgcacccctcctgctctgggattgtgcgcctagctgatgcgccatgaaacagaaaatgggcgtcctttccaagcaaagaccccgagagaagccagaagatgcaggtgtgggcccagggagctgcagacagcaaggcttgggcccagggcctgcactgcccttcccgacacctccggcagtgggcccctgtttccctgccattctataggaatggtactggcatttttccagaaacttcagtctgtgtggactaagagaaaagaggcaaaagaagtgcaggctgccatccgcgtgagcatgcaggtgctcaccacaggggctcaggggaagtctcccagcccagggaggcaccggggaaggcccaaaggcacaacccctcccccagaacagggcagagccctgcaatgggcagcagctgctggagcagctgctcggaaagtgtgctggcgggtgcccagtgaatggcaggatggcctcatgtccaagtccttggcgccttaaggctaggggcttgctcagtctgcagacagaccccttcaacaggcttcctggtgggggctggccttgggccatatccccatccctgatcccccacccgagacctggagactggggggctccagaagggtggagaggggcccctagagaggtagctgggaccagccaaggtggcggggcgcagcacgtagtgactcctccatgttagcagagggacctgagcaagccaaatggcccccctgggcctcagactcctcctgggtagaccccagggcagcagtatctgcttaggggcctggccggccagatgtgaatctggctccgctatcagtggctgtgtctggcctatcagcctttctaagcgctgggctcttcctcctccatgaagtgagaaagccatgcggggtggctgcaggaagagctcagcacacagtgagtgtcaggcatcaacacccctgcccacccctatatgggaatactggcgagagatgtgagggtgtcactggcagagccgctcattagaaatgtttgggcagggccaaatgtttcctcctttaactgctggaatactactgatcttctgtttccaatcaccttctcctcaccttctcagtaacccaatactctgtcacgccatcaaggttcttgactgcataaaacatgagggttctgaggcatcagggatgtctgtgaagccctggcaccccctctccaccatacaccccacagcacactcggcagccacaagcacccacacacactcacacatccacgttgcacaagttgcagtgcaggtcttcaatgacatgtgcgtgctggcttcggttgaagatgggcaggggccccgcatagctcttgtcccgcacgttggcatctgctggatcgatggagacggcggtcaggtgcaccacaaggtggccagcaaagatggcgcccatgcactggcccagcaggttaaagactcactccactctgccggctgggagtcctgccccgttccttgcagccagagaactccccactgccatgccagcccgctttgtgcagattctctgcctctgccacctcctacctccagtcccccaaagcctcctcatcagacctctccaggtaacccctatgccccaaatggaaagagggagaggccatctaggaaaggagtccacagccagccagcagtgcctgctgtcgccacctaggtgcccaatcgcagggtcctggcctcactgctccaggcctggtgcaggccctggctggtctgacctcaggctggtttctggtttcagattccaaatggtgatgtgagactgaaagagatcaaccccacctaaggtccaagaacctgaagtttaagtcccagcttccttatcttgctttcataggaagtcacctccaaaagggatgcagccaccccccttttcagtagctgggccagatggagaaccccttgcagacacggattcggacacttgctacctcccctaccaagaatctaggcacctggagtcctgggctgagtgtctggaatggcctgccatgttcagggcctggccagggacagcatggctagtctctgaagctgaaacagctcttccaggatctaactgctcaatgactgggccaaatgcaggagacaagtttgctgacaatttgctacaaagtctgatgtttaaaaattcacccatagattccacccaggcagccatccactctccctcccttgatcacacccacttcagcccaaaattccactggtcctcttgctagccaggcagacatcatccctccatcattcatgctctacccatcatccatctgccatccttcattcatcagctgtccaatctcttttcctcccttcctcctcctcccagcagccaaatttctctacatatctgcataaaccaggctccgccctaatgtgccataagcatagctaagagagacaatcctgtggccatcactaccccttctatccctatggccaagtcttcatctcttgcctgtgccactctatagcctcccaactctgcgccttctgtctgagttcccttgagtctatgcttcacatggtctcagagtaagtttttaaaagctcagacccaaagccctccctgcttgcaaccctacagtgggtctcaacagctctctgactgaaattcactcctctgctcagtgctaaggtccctttccctctggctcctcccaaacctctctgctatcaccagctactgtgctcaccatgccatccactcttcagacactgaatgagggcaaacatttactccctgcctgctccaactcttctcccgcctcacccccagggtcattcattcagctgtctactgaggtcttttgttgtgacaggcattgagggatacggcaggggcaagagtccctagcactgaagagactgcagtctggtggaaaacatggaatttttttttttttttgagatggagtctcgctctgttgcccaggctggagtgcaatggcacgatcttggctcactgcaacctctgcctcccaggttcaagtgattctcctgcctcagcctcccgagtagctgggactacaggtgttcgccaccacgcctggctaatttttgtatttttagtagagccaaggtttcgccatgttggccaaggctagtctcaaactcctgatctcaggtgatctgcctgccttggcttcccaaagtgcagggattataggcatgagccaccactcctgcccaaaaacatggatatcaatcaaataatgagttaattacaatgaagaaagttcgtgggactatgccagtttataaccaaatgacctcatctagtctgaaggggtccagaaggcttacctgaggaagtattgtctcagctgagacagagaggaatggattccagggacctggcaggcaaagaggaaagggggcctggctagggactgtggctgtggggaacatgtggagtgccaaccagcagtttggctgaagtgtgcctccagctcacggctgtcttgcaagaatgcaagaatgagggtctgtgtggccaatttctggcttctcaaaaggaaccagaagtctgggtttttatgtgagatctctcaatgtttaaatgttaaggaaataaataatttaaaaaacatgcctatagaaggaacattaagatctgtgcattttctttgttaactatccttcaattcaaaaaaacaaatctgcaggctggactggcccatgggctgctagttctcggcctctaatttagctgcgtgttgggagcagggagagagacaaggggcttccgggcagagaccagtgccgtggaaacagaagaggacagggaaaatcacatcagaggaaatgggggagagaggcagagtccagaatgcggagccttgacgccatgttgagcctcatttcttttgttttttgttttttttttttgagacagggtctccctctgttgcccaggctggagtgcaatggcgctatctcggctcactgcagcctccgccccccgacccgggttcaagcgattctccagcctgagcctcccaagtaactgggattgcaggcgtgtgccaccatgcccagctaatttttgtatttttagtagagatggagtttcgcatgttggccaggctggtctggaactcctgacctcaggtgatccatccgcgtcggtctcccaatatgctgggattacaggtgtgaaccatcgcgcccggccttgagcctcattacttaaggcaggaagaaaccattagaaatcttggagctggggcgcaacattatcagatttggtttttggaaagagcaggaatgcagatgggctggccgaggtgagagcgtgtgtgtgggacccgtttagaaactcagcggtcatccagggaagagaggcagttggcagtggcagaaaccgggagccaattcaatgtctatttaggaggcaatatcaacagggctggatgactgactggatttaagttaggaaggaagcgggaggagccaagagcatgtggggagaggtggggcgggggagggggggagccacaggccacgagtgtgcctgtggacatgcggtgatactggtgtaggtggcctctgcttgccctcacagtctgctgcacttaccatgtggcgtgatcaccacgtggcgtgcaccagccttcccttcagctgggggcccagcaccctagggctcagcttgtatccctaaggcccaggccagttccaggcccaaggtgggtacctggtacccattatgaccttacctcacttctcaggggacctgagagagcctgcagaaagaaggctttgatggaaggaaggagagcatataggctggtcaggcatgaaccaggtggttctgtgagcctctgcaatgctcaaagcagacgaaccctgaatgcggagacaaagccctcaacccgcccctctcaggacagtcaggcttcctgggcagcccatctggcctcactgggtgcccgctatgtgatctcaggaagtcacagaacctctgtgcccagcttcttcattaggaaatggggagaatacctccttaaggattacaatgaggaccaaatgagatcattcatgtaaagtggctgacgcagggcctggcacatgtaagggctcaataaagtctactgccttctgtttatcatgatttgctctgcttctacttgtacaaggcatggggttgttcatctggttaatctggtttcccaggtatcctgatgggaggaacccaggtgatccctagtgaggggcgtgtccattccagatcacaggaggaatgtcccatgacgcattcccatgtcccatgacttaacagcactaagacctgttggtcacctcagggaaagtccagttttccattcacagagctgatgaccagaccctgggctctagtgaacaagaagcccccagatggcactgctgtgtctgaggatgacaacctcctctagggtccgcctccacatacctaccctgccactcaccagcccagggctttgcggtttcctaaaagagcatgttcacatttgtggcttaatgaattctagtgctcacatatatcctaagtgctccaggtaggagccttcccatcagacagaggaggaggcaaagacccacagagctggcaggagctgctcggtcccgtgcagctctgaaggtgctgagcagggacagagctcaccacaggctggatgtcccaggctcttaggcttatcgccgccaaccacccttagaccgccctcaccttccccacaggagtcatctttgtgaaggacactcaaataggaactctctggaaaggagcacagagatgcctgcttcactgcaacccctggccttgcagccacatcctctgctcctgggggctgtggccagggatggggcaatcacaccactgggctcaggcgagtctcggtttgtcactattcccaggggcattcgaggtatctccatcccatctcttgtcacattcaacctcactctaaaagggtctgatgtacagaatcaatgtgcccataaacagtcctgggcacagtctgtccatgaataaaaccatattttaaggcaccaggacacttattatgtaaaagaattctacggtgactctttgaaaagtgaaaaattcttcgatagatggactaattactccctacttcatcctttgttcagctctgaacacaattagcatcaggatggtttgaggctcctccttctatgactgctcctgtggtgcctctgtggacaggattcacatctttgtggggcttcatatgctcctaggtattttaggcatgcccactcaccctatcaggtggagaggtcaggtggaggctggagacaggctgggaagcagcaagtccccaggactgggcccaccctgctccactctcctgactgtgctccccaaggctctcaacccggctttgggcctccgctgtgccagccatcctttgcctccccacttccacacaccagccctacgctttcccaaggatacagcgtagccagcgggcacccagtggtgaggcaggaggggaacaaggatcccaaagccgatcacagcaaagaagaggtacagcagccaggccacaatctggagcgggtgagggggccagctccacccattccggcgggatcgctggccctgcagctcaggggagggtccgctgggctgtgccggtgccgtccacacactcttctcaggggccgtcttgttggagggcttgttgcagatgttcatctccagagggagaaacagtagagagagcattagcccaagaagctgggctggagcccagggcctgtgtctgcagccaagtttcagcacagggggagtaggctgcgacagctactctgctggggaaactggggtcctagcacaatagagatgggcagtggggagagggtgggagtgggctgctgtctcaaagcccaaagcaaaccctggccctagactggccaggacaaggtaggagggcccaggatttattcaggacacagtgctgctgcctgtaactcaaagtgctgtcttcacagccatcacagttaaacccaataagacatgttctcatctggtaacaatatcaggctggggccagagtgatgagaacacatgctgattctgttaggattagtcacctccttcctgaggtccaaatgcaagtgtcagacacccccgctatcctttgctcagggaaacggggaatggggtgcccagaaggaggatctgccctctcccccacggtggacagaaaatccctttaggactgggggagtctgaagctctgccccatgctgcctgagggttctcagctggggaggggccagcacatgtgaggaagggaaggattcctctttagttcccttcagcagcagaaatgaccacgtttctctaagtaaatctgggcctggtgtacagttttgtacagaaaggtgggctaacgcccttggactcagagccagaccaccagatggcatcaaccaccccctccacccgccaccctctagccggacagctggcccagggtccagggatgaatgccaggcaagaaggggtaggctacaggaggaagacccccatccccaggatatgggcccaagatgggacaacagctcaggcaggcagcgccacacctgggagacaggccagctctgcgctcatggtgggaaggccaggagctgggactaaaaccctggtagctgaactctcctttcaggagcccctgcccatgagacagggaacctaagcagaaagggtgccgcagaccccgactcagtgcatcttcctggatcacctttctcacttctcaatccacagaatgaggcttgatcttcagagccaactgcaagggttgcctcatccaggaagctttccctgatgccctgagtcagggggcccttatgctaagtcattgttgggcaaattactttgccatttgggacgctttgcaatcctcatgtctgccctcattaggacaactttccccaaaggcagcaaatgtgctgggtggggtttattcatctctgtcccctatgtcccttcccccaggcacccaaaattgtaccttgtacatagtagatcctcagtaaatgtttgctgacttgaaaacagctgaaataaaaggaaacgtgggcacagtaaatggtgtggaatcctggtccaccctaagccatctggcctgctttctcctgccttccatccatccagccctgccctctttctgcagggtcgtgaacccatgcctcccgcagcccatctccctctgccggctggctaccaccctgactgccagacactcactcctagccaccctgcccttcagcccacctgaggctcagagcctcctgcaggccaagccaagcattatttgaagtgacctctgagttgtcccatctcaaagctaaatggaggacttagttttcccccagggattcaactggtggtatttgggttttgggtttagggtttttttttttcttctgagacaggatcttgctctgttgcccaggctggagtgcagtggcaccatcacagctcactgtaaccttgacctcctgggctcaagtgatcctcccacctcagcctccagagtagctggaagtacaggcacgcaccaccacacctggctactttattttatttttttgtaaagacagggtcccactatgttgcccagggtggtctccaactcctggactccagactcaagagatccgccagccttggcctcccaaagtgctgggattagaggcgtgagccaccgtgcccggccttgctttgttttgttttgttttttgtttttgaaacagggtcttgcgctgtcacccaggctggagtgccgtggcgcaatgatagctcactgaagcttcaatctcctgggctcaagtgatcctcctgcctcagcctcctgagtagctagaaatacagcggcgtgttgccatgcctagctatttattttttatttttgcagagacagtcccactatgttgcccaggctggtctccaactcctgggctcaagcgatcttcccactttatcctcccaaagcactgagattacatgcatgacccactatcccagccctcactttcttttgcatgtccccaaagatagcaaatctttgtccttgtattgtggaattgtcaaaggtcatcaggtcaagccctgtgaatatgattgggttggatggttctgctctggggccaatctctgtggcttgcacatcagctccccagtgacaccatcaccagggcaattactttgaaaggaatccattaatttggattcctaaattctggctctccttttgccatccccaaacctgaacaaccctacaccttgcaggagtttccaaagagcaaaacagacgcatgcagctgatctggccccactgcctggcagtggccacaggcacccccagagctgctgtatccctgactcctgaggcaggaggagtcaccatctgcagccaggcgcccgccacttacagccttggggatggctctgactccaaatcaggataccccctgatactccaaatcaggatacccgctgatactccaaatcaggataccccctgatactccaaatcaggataccccctgatactccaaatcaggatactccctgatactccaaatcggataccccctgatactccaaatcaggatacccccgatactccaaatcaggcccaggaagggagcacttgtctgaggctgtggatgtggggatggtgctgccaggcagacctccctcagcagaggcagcattctggtatagacgcccaggctggcccagaggcatgcccaggccagcccactcttcactgacgacattttctcctgcagagttggtggctacaaattccttcggcccaaaagattttgattaaaagggctgggaggtcggagagaatccaagatggggctcccaggcccatggatgggaccaagcactgtcaccagaccccgggacttctctggctgttgctcccctctcagcacttctctaggagaccagattgaaagacatgtggctctgttctccaacgacgtagccagctggcaccctctgaccttggccagtcagcacttatcggagcccagcctgcgcacttaggatgtaaacacagatgagaccgggtgcctgccctcaggggcttctcttctgggacctggacggacacgaacagataccagggcagtgggtgaatgggcattttggcagcccatgcaagggccagccatccaatgtggcagaacacagggtggacaggtggcgggggtggggggtgggggaaggagggaatggagagcaggacccagtgagagatgggactgaaggagttgcggggctcagatcacaggggtctaggaggccaggtgaggacacatgggcactgctggaagagccacatggaggcaaagcaggctgaaggcatgagagtgacccaatggctcagggtgctttggaaaactttctagccagtggggaggagggcatgggggaagcggcaccacagtggcccagcagggagcccagcagccctgtgctttgggagaaacttgtcagaaggtggcggtgaagcccacaagctccttgctgcccacctggctacctccagctgcatctttgcaaggctcagaggtacacagccttgggaaaacattcttcatgtaccttctactgccacagaacaaaccatagagagtcaggctggccgggataaagggaagacaggaaggagggtgtcccgtggcctgggtaagccaaggacccacctggcttctgaggcaggcaggaggggctgtggaggcccctcccttatcccccacaaggtgaaagccattggcaggatgacagtaatctgttcacattaacattcacttgctaaaagccttagatggtgttttcaatataaggttaggctaccttaattaattattattattattattattattattattgttattatttagactgagtctcactctgtcgctcaggctggagtacagtggtatgagctcagctcactgcaacctccacctcccaggttcaagcgattctcctgcctcagcctcccaagtagccgggattacaggcatgcaccaccacgtccagctaatttttatgtttttagtagagacggggtttcaccatgttggccaggatggtctcaagaactcctgacctcagatgacccactcagctcggcctcccaaagtgctaggattacaggcatgagccaccacgccctgcctgcgtaccttaatttatatgcttaagtcaaatgaaggaaatcttaacattttaagttctcattacgaactacattatagttacatgagtgacccactttcctcctgcccacctctgctcccaacaaaaaaaaaaccatttaggaatgttgttctgaaattcatgcctagcactctcaaaggaaccacaccaaggtgaaaagtaccagccctggagagactgcgggcatccctggattcctgcaagctacctgagggcttcagaatcaagttaattactaaagagggtttgccaggagaggacaaggaactgggagggcagggtgatggggtcagaggagaaagcgacggggttgaagcaggtgcttggagggccctgcactgccaatggggagacgcaggtgggatcaaaggaagagggctgagcctggagtagagcccttttctggttcccgagctgccactcacagactgaggaacattggggcaaatttcacagatccacttctttggatctcttctgtactcatctttcaacaaagttcagtgaagcaatttggcaatatccaagtctggcgaaactttagaacatatatgccctttgacccagacattccatttctaggtatttatcttatacatatactcacaaagatttactgcagcattgtttgcaataataaaggacaaaagacaatacaaataaactatggcacatccatacaataaaatgctaggcagcatcaaaagcaagggataaaaaaagaaaaaaaagggatgaagtaatctttgatacacaattaagtgaaaaagcaagatgaagaacacttgtagatggcgctaccaagtgaatgaaaacaaagggggccgggcgcggtggctcacgcctgtaatccccacactttgggaggtcgaggagggcagatcacttgaggtcaggagttcgtgaccagcctggtcaacctggtgaaaccccatctctactaaaagtacaaaaattagctgggcgtggtggtgcgggcctgtagacccagctactcgggaggctgaggcaggagaattgcttgaacccgggaggcagaggttgcagtgagccgagatcgtgccactgcgctccagcctgggcaacaggcgagactctgtctcaaaaaaaaaaacaaaaaaaggctgcggggatggatagatatctacattcctatacgcacagattttctccagaatgaaatgcaagaaaccaaacacaggagcatcccctaggaatgagacctagtggtccaagagctgtaagacagaaattgcatttcctggtactccttcaaactgttcaaatatatatatatttttatcatgagcatgtactgcttttgaaaaaaaaaaagtatgtctaataataaatgattaggggatgtcacctcctgccttcctggccccactgagctgccttgtggatgaaacacactcgtgtgatctagagccctgttatcatgccagacaaagaattcctgcctaacaagggggcttggttttagtgaaatgttttctcactcttgaaagcaattctaagacgcttggctgcagagctatgaggaaaagccacagaacttcctatgaactgttagggatcttgtcaaagctggaatcacacaaccagacagcacaacagaggagctgctaggcaggacctgcttcatccttggccacagccaactcagctacctgagactcccagaacccgaagggaaagtgcactccacaggaaacttttgttcccatgcatcttgtccttttgctagaggacttgtggtttccatgtgagagattttcttctcttttctttcacttttttttttttaagacggagtttcactcttgttgctcaggctggagtgcagtggtgcgatcttggctcactgcagcctctgcctcctgggttcaagtgattctcctgcctcagcctcccgagtagctgggattacaggtgcccgccgccacgcccggctactttttgaatttttttaatagagacggggtttcaccatgttggccaggctggtctcgaactcctgacctcaggtgatccacccgcctcggcctcctagccactgcacccagcctattttttttttttttaagagacaggatcctgctttgttgcctaagctggagtgcagtggtgcaatcatcgttcactgtaacctcaaactcatgggtttatgcaagcctcccaccttggcctcccaaagcgctgggattacaggtgtaaacaaccgtgcccagtcgggagattttctatctatgagtattcctaaatgaactttccgtttcccccaggatctgcttttgaaataattttcactgagatttaacagatgcccagttgaactacctaaagggaagctagaaagaaaacacttcacggtacacagatttttacactgcaaaaagtcatttacaaaagattctttagggacaagtactttgtttattaaaattccccacaggtgccagagaagtctctggccttaaaattctgagaagcagctctagctcaactaacggatgcgcatcacacaactaccaaaaattaaactggaacttcaagctgttcccaaagacctctcaagtcactgatctcagatgtggctgggcccttgctttctctctcataaacaacaggtggaagtctgatgctggttggacccagtggctcatgcctgtaatcccagaactttgggaagccgaggcgggcagatcacctgaggtcaggaattcgagaccagcctggccaacatggtgaaacccgtctctactaaaaatacaaaaattagccaggcatggacgtgggtgcctgtaatcccagctactctggaggctgaggcagaagaatctcttgaacccaggaggtggagtttgcagtgagccgggatcatgccattgcactccagactgggcaacagagcgagactccgtctcaaaaaaaaaaaaaaaaaaaaaaagtctgatgctatggcaagaaaagcttgaaactccaattattcctgagttgacatggtttgcaaacattttctgtgccattctcctcctgaagcaaccactgcaaattgtttgggatacaaatgaagccaaggaaaggggacaagtaggagggagtaacacagaatagaaacaaggccagtgaagagaggccaaggttattgactttaaccaggaaatcaactcatgactgcaggagccagccttggggaacacccaccacacaagagtcattaaaaacaacgttgtgacagaacaaagaaagaaaaacaaaaacaaaacaaaacaatctggctaattaagcaccactgttgcttttactgcatctcatggtgattatctgtttacaaacccgtctcccacagtgaaccaccagttccacaaaagcagagaccacccctcacccgtgtctgaacccagctctctttcagtaaaggaagtcaagccacttttttaccatctctgctgtcattaccccaatccaaacctccagcatcgctctcctacagtgtttgcatgataataaccaacaccagcatttagaatgcacttattctgtgccaggcactgtttcagtggaattcactcattcaatcctcatagagctctaaggaaggtcctatcatttccaactgttcttgtagatccctgtagtcactgatttcagatgtgactggcctctcacttcctcataaaaaacatacagaacacccactcccatcatgaggacactgaggctcagagacactaaatgagttattttaggaggcacagctagattggcagaactaggatggccctcaactgacttcccggtatgtctgtcacaaccatgctgctcagcagccagagtgaagtgagcttttcaaacgtgaaactcatccaaactcttctttgggaggccaaggtggctggatcacctgaggtcaggagttcaagaccagcctggccaacatgttgaaaccccgtttctactaaaaatacaaaaattagctgggtgtggtggcaggcgcctgtaatcccagacttggggggctgaggcaggagaatcgcttgaacccgggaggtggaggttgcagtgagccgagattgtgccattgcagtccagcctgggtgacagagcgagactccatctggaaaataaaaataaaaataaacaaaaaataaaaaactcttctgccgcttgcagtggctcacacctgtaatcccagcactttgggaggctgaggcaagaggatcccttgagaccaggagctcgagaccagcctgggcaaaatagtaagacctcatctctaccaaaaccttaaaaaattagctgagcgtggtggcgggtatctgtagtctcagctacttgggaggctgaggcgggaggatcgcttgagcccgggagccggagcctgcggtgacccatgttcacaccacagcactccagcctgggtgacaaagggagaccttgtctcaaaaaaataaaaaattggctgggaacggtggctcacacctgtaatcccaacgctttcggaggccgaggcgggtggatcacctgaggtcaggagttcgagaacagcctggccaacatggtgaaaccccgtccctactaaaaatataaaacttagccgggcgtggcggcgggcgcctgtaatcccagctactccagaggctgaggcagcagaatggcttgaacccgggaggcggaggttgcaatgacccgagtcgtgccactgcgctccatccagcctgggtgacaagagcgaaactccgtctcaaagaaaaaactaaaactcttcccatggtttccttttaaaacagaccctccatgaccaacccctccatttcaataccagagagcctaacccgacctgaaatcactttagtcatgtatgacatccgcttcccagcccccttccttaatgctctgggttctggagacagaccacgtctgttgggagtcctctgtgcccacgcctggcacagagcctggcaaagagtaagcgctcaaggaagatctgtgaacttgatgcatgctaaaaggaagccccgcgctctgccggggccctggaactcaggccaccggctccaggcggaagcgagcccaaagccggccaggcggcagcatccgctaccccgtggctcaagccaggctccgaggtgagaaaccgggcggggactcctcacctgcgcgccgcggaggccgtgccagatgggccctgccaaagtcagccagaggttcgggccccacgcctggccttccaccctccccggggcagccgcgcctcagaccctcgcggtagggacggtccccgggactgggcggcaacgcgcccgggagcggggccccatcccggacggagactgggccggtgagtcctcgagctctggctctggctccggctccggctccggctccggctccggctccggctccagcaggctggaggggcggccaggccagacccagactggctgggcctcgtccggcgctgggcccgttcccctgacaacggcgcgggctacggcgccccacagcggccaaaccgcgctgcgtcactccgcgccggtcccccggccagggcggggcttgccagggaccctcttggtgccccagtcggcccattcccagattcttcctaacctttcgtctagaaaatccgcttttccctactcccgagtcacagcttgtctccccgaaatcctaacatctcaaaagcgcccccttccagtttctatcctgagaccaccgctctcaagaagagacctcccccaaccccagtcaacctgcacacttcaatgagcgtatgtgctggaacatccatgatatcccgacccttccgggagcttacaggttaagaggcaaacagatctagacaaataaattacaccactaaaaatgcaggtaccccagaatataaagcgagaagcgtaagagcttaaaataagcagcacaaaatatctcatttatttattgcctttaaatcaagcaaaaatcaagccccaatcttccaggctgatgggaaattcagtctttttctattttttaaactggtctctgttacccaggctggagtgcagtggcacgatcacggctctctgcagcctcgaactcctgggctcaggcgatcctcccgcctcagcctccagagtagctaggactacaggcgaacaccaccacgcccgactaattttcgcatttttttgtagaggcgtggttttgccatgttgcccaggctggtttcgaactcctgaactcaagcgacccgcccacctcagcctccaaaagtgctaggattacaggcgtgagcccctgcccggccgggaaattcagtctcagtctccactgtactccttttagctaggtaattccaaaggactcatgttttcctatagcaaaaaacaacaatcaaaaacaaataagcaaaaaactctctggtcagggttttgtctggtactgaggccacaaccattgctccagtccacaaagattttcaggtttgggctctatgaggccatccctgcctgaggcccctgcctctccctggggctgccagggacagacacctgcttcctctgctccatggcctgcagcctcccttccctttctctacctgggagacttccctgctaacttggtttccctaaaagtcccctctcctcttctccttgtggacactcagaatggaatcttctatgagctcaggctttctcaaaagacaggaagacactttgtcttctgctatctgtcctgtgcgcatctccaaggcagatatgacagatagggaaagaaaacatccttatctctaaaatgtataagtcacaagcatacttattgtatgttttattaggcaacataactactccttctctgtcacatgacaggtgtgtgggtccttgtgcaagtgacataacctattacttaaattcttgttttcaagactgataaactcaaactcaatgtgagataaatatcaatgctattctggcttcagagtacaagctgactacttaactcttatctggaattggaaaacttcgggtcaaacagagatcatgacccagaaatcaaggtgaaggatgaggctggatgcagtggctcacacctgtaatcccagcactttaaggaggctgaggcaggaaaatcacttgaagccaggagtttgagaccagcctgggatacatagagagactcccatctctacaaaagatgaaaaaaaatagctgggcctggtggcctgtgcctatagtcccagctactcacgaggctggggcaggagaaaagaatcacttgagttcgggagttcaagattgcagtgaattacgatcatgccactgcactccagcctgggtgaaagtaagatcttatctctcagctggtctcagtggctcacacctgtaatcccaacactttgggaggccaaggcaggtggatcatgaggtcaggagatcgagaccatcctggctaacacggtgaaaccccatctccactaaaagtacaaagtaagccaggcgtgatggcatgtgcctgtagtcccagctactcgggaggctgaggcaagagaatggcttgaacccaggaggcagaggttgcagtgacccgagatcgcaccactctactccagcctgagtgacagagtgagactctgtcacacacaaaaaaaatcttatctctctctctctctcttttttttttttttttgagacggagtctcgctctgtctcccaggctggagtgcagtggtgcgatctcagttgactgcagcttccacctcccgggttcaggcgattcccctgcctcaacctcccgagtagctgggattacagttgcctgccaccatgggattgcaggcatgagccactgtgcccggtcagattttatctctttaaaaaataataataaataaataaatattttaaaaaacaaggtgggactgggcatggtggctcacacctgtaatctgagcactttgggaggccgaggcaggcagatcactagaggtcaggagtttgagaccagcctgggcaacatgacgaaaccctgtctctaccaaaaatacaaaaattggccgggcatggtggtctgcgcctgtaatcccagctactcgggaggctgagatgggaggatcgcttgaacccaggaggcagaggttgcagtgagccgagattgtgccattgcactccttacaggcgacagaacaagactctgtctttaaataaataaataaatgcaaatacaaataaaaattaaaaaacaaagtgaaagatgaatccatatattcccataataaggggagggacccaaaagaccctggatccacttgactcaggggcttctctcctggatgtcccattggtgtctgggatgtaacacatccccacatgtcctctttgtccttgccacaaatctgctcctccccttgggccctctgaagggcaccaccatctacccagtaagcccatctgtacacttaggcatcttcccatgtctctcctgctagtccttgcccacctaaaccagatagtgcctgtgaccaggctgccctcactctgaaacacattctgtgtccattcttcctgctccaccccagcccagaccaccagcatcttccttgctgagcctgcagcagcctccagttctccctaacatcagcctgcccacttccggcccatcctcctctcagttgccagactatccttccttctctttgttagaggaggtagtagtctgaatgatagcgccacaatgatgtcatcgccctaatccctggaatctttgaatgtgttatgtgatacatcaaaggggattttgcagatgagatgaagttaagatctcaagatggaagagattatcccaggttatctgagtgagctcaatgtagtcacaaaggtccttataagagggaggcaggagggtcacatgggagaaggaccacgtaacgacagaggtcagagagatttgaaggtgctacactgtgggctttgaagatggaggaaggggcctgagccaaggaatgcaggcagcctctagatgctggaaaaggctagggggcagaccctcctctagaggctccagaaggaatcagcctgctgttacctcgactctagcccagggggacccatttccaacttctgacctcaagaactgtcaagatgacacaattggcagtgatttgtttcagcagcaataggaaatggatacagtggtttgcaaacagggttaagtgcacatatatatgcccagtgaaagctgttttcaattgaaacaaaaatccaagagacagctcagattcctttgacatcttttattttttaagcgggcgggaggggggtggttgggggggcaggggatgagttctctctctgtcacacagcctagagcagagtgccgtgatcttggctcactgcagcctccgtctcctgggctcaaacgatcctcccacctcagcctcctgagtagctcggactacaggcatacaccatcacaccttgctcggggttttttttgttttttttttttttttgtacttttgatacagacagggtcttgctatgttgcccaggctgatctcaaactcctgagctcaagccatccacccacctcagcctcccaaaatgctgggattacaggcatgagccatggcgcctggcctcccttgacatctttttgcatgactccaagccaggttctgtgagaagatgattctctcaccccaaatctgcttttgaaaagcacaggcagtttgatcatgctttttttttttttttgagacggagtcacccaggctggagtgcagtggcgcaatcttggctcactgcaacctccacttcccaggttcaagcaattctcctgcctcggcctcctgagtagctgggattacaggcctgtaccaccacacccagctaatttttgtatttttagtagagttggggtttcaccaggttgaccaggctggtctcgaactcctgacctcaagttgatcatgctctttctgagtctgtcatccttgtgtggtccccaatccagaagctgacactgcacagggcatcaccgactgaggaaagtcacacgttgcctggcaggtgccagagaaatctttctaaatgtgaaaacaccacctcatcagccttgcttaagagattccagggctcccttttgcctttaggatcaactgaaatgacaaagtgtggcttccaatgccctgctgggcaggcttctggtatgtggagcttcttcctgtcctctgtgacgattctgcagctcctggaactggcaacatctgttttcaccctcaggcttcttcccacagggttctctttaacttgtgctgttccagctcctcccgacaacaccccctccccaacctggccaatttctatgaaaacttgagaccattttatagaagtcagccccttgggcaggacttgttcctagccagagctgcagccagtgattcgcaagggaggtctgcccaggatagaacagccaagggccacagggagaaaaaggccaattgtggttttccaggtgtgcacacacacatgtgagctgacttacagggctcctgggagctgccagaggtgactccacagggacaaagctggatcagcccaccctgggcctgaaccaacagatacgtccataattagagccagtgtgatcccagggttccgggcactcttcacctgtcccagggcaggttagtggttcaatcttcatggtgccagttataagatggtgaccttgggtaatttttttttttgaggcggcatcttgctttgtcacccaggctggagtgcagttgcacaatctcggctcactgcaacctccacctcccaggttcaagcaattctcctgcctcagcctcctgagtagctgagattacaggtgcccaccaccatgcctggctaatttttgtttttgtttgtttgcttgtttgtttttgttttgctttttttttttttttttttcctagtagagacagggtttcaccatgttggccaagctggtctccaactcctggcctcaagcgacccgcccgcctcagcctccaaaagtgctggggattacagacgtgagccactgcacccagccataaattcttcaactttaataatctcaatttgcttgtatttgaaatgggggtaacaatagctactgcctagggctgtgatgaggcctgaaaatgtggccatgcatatagagcacccaaagagtgctcgatgggtagtaatcactggtgcctcccatccagaccgtccttgtctttctaccaggaaatgatgctgtccgcatcatcaacgaatggaagtaaatttaattattaaattagactgggtgggagatgatcagccacagctctcgctctctgggcccacttcgtctgggtcacagtaccctctccaatgggccctggatgactcagcccatccacttggcgtgtcttcatggccaccagcatctcttgccctggctttctgactggctcttgatttccacgggggccctccctgtccccgtccccacccctatcagtccattctccttacagcctgtggctgtcttagaacaaaaacaaaatttaaaaaatccacgccaagctgattcttttacttcctgcttacaaccctcaacaacactccccactccttagggagaggtatttccatataccatgaaattggaatagaaacctcctcctcactgtggccaccgcagtctccaagaccttgcgtgccccctggctcaggctgaccacagctctgtctatcccacggcctttgcatttgaagctcacactacctggaaacttacttcctctgggaaagccctctgtggtccccagaatagagaccatcattcccatagcaccgtgggactctgctttctcgttccttctctctgggtctccttgattgtgtaatgatctgataagggcctgtccctccagtcagacagaagaggagggaattattattcctcccacaggggaggaataatgtttgtattgtttactattgcttccctagcacagagcccagaacatactaagcactcaagaaatgtgtgttgaggctgctgtaatcccagcacttactaagcccagaacatactaagcactcaagaaatgtgtgttgaggccgctgtaatcccagcactttcggaggccaaggtgggaggattgtttgagcccaggagttcaagaccagcctgggcaacatagcaagaccctgtgtttacaaaaaatttaaaaattagcggtgcatgatgacgcatgcctgtagtccaagctactcaggaggctgagaaggggaggatccctggagcccaggagttcgaggctgcagtgacctatgagtgactgcaccactgtagcctgggcaacaaagcaagactctgtctctaaaaataataatcataaagaaagaaatgtgtgtcaaacacgtgaagaataaaaaaggatagcgctacttataggaattcttctgtgaagccttgtgtaaataaccaaattatttttgtgtaaaaatggactttcctatattatcccacctcttcaacatagtaaatctattttttccatgttccttgttaagctttttgtaaaatttgctgcattcaaggcactttcctcccattaattttcttccctgttaagtggtttttacgaccacttcatgctttaagcaagaagtgccatttagtatttaaaatattctctcagctttcttggtgagatctttggcaaccttcctactgttgattgtaactggtgcgacttggaacacgatgtcactcttccagaactcttctcagacctagataaaacttactctgtgtcaccagttggggacaaggtgtttggaaacagtaccttatgcaacagaactgctggagggccgcccctcagaggcaaatgaaataaaaatcatggtgtgtggaaaatgtgcccgcagagtcccaggaaccaaagattttaaagcttctctgccagtaattcagtttttattttatgtttcttggaaaactgaagtcttgtgtttaccacgtgtcacctaagatgcagaaagggggaaaaaagtgatcctggttggtgaagatttccatttcaatggcagcctggtccaagctgttctcttgcaactgactcccgcctctcccccaccagccccctcccgcccctgcacaggctccctggggaggggtatttcctttcagtgtgaaatctgtctttttgctcgctcatttctatggggaatggcacatccatgcaaagttgttggctgctcttattttatttcaaaaatgtgctggcctcagacacctgaagttttcctcgaatactttaaagcaaattatgtgcaggaacctctcagacctgctctcaccggaatttcctttgagtgttcatatctcagagccttatgtaacctgacacaattatctgaaaaagcttggaatccaaaagaaaggtgttctgagctaggaatgaaggtcagagctgggaaagaagtgctctcccttgcctggggactgggtcacacttcactacgacaatgcccaattcacgttccaaagaaaaaatactaaacctctggcagggtgaccagtgggtacactcgcctcatttctctgaacaaggaatcgcttaatgagggctcccggggcattacaaagccttggacctggctggcggttaaaaatatttcgataaccacctccagcttctggccttcccaggatggaagcaggagtggcttgggcccctttaggagaataacccctccgctgactgcaaaaatcaacccagctggacagttggggtctcgtgccggaggtcagtgctgcaaatggggtataggtgggggtctggaattcacatttttataccaagtggttggtctaggtgatttgactcaagcctggcccaagactcccccgccccagcccactcccaacacaaggcggaaggagagcgaggacattaactgtaagtacagacctaaaactgggggcaaccaggagatgaccccgcattctggaaagccctcaggccaagaagctctttttcttcttgagaaatatcaaccctgctcgatatttgcataccagcggtgagggacctccacggagcagaggcaccactcataggtggttgacttttcaaggaattcgctggagaaaattgtacgcaaggctgtgaacaaaacccccctccatctggtttcagtttatttaaaaaaacaacacacacagtcctccccaccagcaatcagaagacagccacagcttccccagggggcgtattagccaccaggggtggggctgaattatgtatatgcaaataaattaaaacagccagccaacagcaactaatttttgtatcttttgcagttgttgtgccaagaaaaggcctgaatcagggtgatggaagctgtaaggagacaagtttggaatgagttttaacaatcaagttgcctcaattccgtcgttgggagacttgtttttaatcgagcagcaaatagcaaaaggtcggtagccttatccttatgtataggataaggataatgatagtacctacttcatagtgatgacgtgaggatagtaaataaaataaagaccaagcaagctaagcacaaggactggcatgccacaaacacacaaccacactggaggatacaagacggatcctagaaggatttcatccagagtcagtcaagctctccctccaaatgctctcagctgaggcttgctttccgcctgggactggtccagaaagccctgcagaacatactctctctgtttcccaaactcaaggaccctaatccccaaacatctgcctttaatcctggagacagtaaaagttcggaggagggtgccagacacaggctgaaaacacaagtgatgctcctggctttctgtgtcttactgcctccctctctggtaactggaggggaggtttccttcagttccgtaactgaagggcctggtttccaggtgcccagcccagatgggatagctctgaaaaatggtggaggcaggggcgagttcagttcatgcctagggtaatcagaggggagtcggcaacctccagggctcccacgctacaggagcaacatgctggagcccacaggcttccacctgccttggggctcagcctttgcatgttcaggggtgcctcaagctcagtttgtttgaacagacctctgctccgtccctcatctggatgcaggaacaagactcccagcctcaagaatcacttgaagccagcagttcaagaccagcctgggcaacatagtgagacccctgtctctacaaaaaatttaaaaaacaatagccaggtgtggtggtgagtgcctgtagtcccagctactacggaggcctgagatggcaggatcgcctgagcccaggagttcaaggctgcagtgagccgtgattgtgccactgtactccagcctgggtgacagagcaagactccatctctaactaaaagtaataataataataataaagtaataatcataataaaatttaagagtgataataataatttagtcagcctccactcttccccagatccatttcctgtccacctgggatgggggtctcatttgctcaaaaccattccaagctctcctttgccctcaggatgaagtctaagatgccacaggtgaccaacacagccccgtattaacacagttctcaagagcccagactttgggttcaggtacacctgagtttgaatcttggggctggtccaagactccaacgcaagtggaacttgagagcttgagcaattcccttcacctctggaagcctcagttcccttgaatgtaaaatggtgataatgacaactactacaaaggctatgatgaggtatctgcacccaacccagggcttgggacacagcaagagatttggaggccagtgcatggcatgaagattgaggatgtggtggggcacgatggctgccaggaccagctttagacatgctgaggctgaggggcctatgtgtgtccaagggaagtgtccaggggcagctggacatgtgggcctgtggtcaaaagggagagcttggccagaaagcaagcagggaggtcgccagcatgtgagtagaaagatgagctcatggtgtggggagggccgagggtgaggcctctacagccagagcttcacccacaaggaagagaagctggagaaggaggctgagaaggagaggcagtgaggtcggaggaaacccggcagccgtggcttcgcaggcacccaagggagacagggcttggggcaggaaagagaggtcagcagggccgaggctttgaagaggccaaattagctgaagccagagatgagtctatgggatttggggactagggggttacgattgggagctggtcccaggcaaaggctgggaggggagagtggtgatggtgattatggacaactttagagaaatgcagctgaaaacagtaggagaaaacacaagagagatgctttttttttttttttttttttttttttgaaacagagtcttgctctgtcacgcaggctggggtgcggtgagtagtacaatctcggctcactgcaatctccgcctcccacattcaagagattctcctgcctcagtctcatgagtagctgggactacaggcatgcatcaccatacctggctaatttttggatttttagtagaggcagggtttcgccatgttggccaggctggtctcgaactcctgaccttaggtgatccgcctgccttggccttccaaagtgctgggattacaggcgtgagccaccacgcccagccacaagagagatgcttgtggaaagggatacgggcttgaggttcccaatgggtgaggctagcgccagtacacttgctgctggggccagtagtcagttgctatatctgtggtgcccagcacagggcctggcatgcagtaggaactcaatacaagtttgttgtctttgaggacagggagcaatggggtctaggaccctggccactggcaggaagagggaccctctgccattctgccaagaggaggcatggtgggggtgaaggcgtgaagcagagtgcagggcaggggctccttgggaatctgcagcctcttagctgcagagggaagaggaggtgacaagtcagtgctgagtgctctgctccaggaacccaagtacagtcagaggacagagcgagagggctcctggagtctgccacttggtaccccctactgtagacatctgttcccctctcctcaacccagcagccggtgggttacctggtctttagctccttcagagccgtgctctccctacacggccagcagagggtaccagtgagctgctggactccgctggaggagaccagagcccgcctgcccacccctttgtcctccagagcctggggcgtgctaagggtttggttaaccaggtttctgaccaaggcgggttggaggctgggacaaaggactaagggaggctgtgggctgagggcttaggggccgagtggctcaggtgctctgctcctggtcacccttcattcctctgccctgccaggccctgctttatctgttgaggctcctgcccactgcccctctccgcttctcttccctggaggcccctgacagcctagactcctgcttctagcagaggctggttttctgcccctaggcaggcacgacttggcaacaggcctcagacagggctgggccagcttctgccagcaatgactgccctaaccaccttgtacttctagaacgtctccacctaataagggataaggggtcagtggttgaggaggccacaggagctggagcataggtcctgggaaggaggaggcttggactaggaagtgggatgaatgggcagggggagtttatataaaaatgtggcagatggtccagtcccaccaagacccaaatcccataagactaatggctctgcctgaggtggcacgaggttccagaagctgagctggaaacacccccttcctcatcctaaccatgttatactcttcagccaaacgcaaatcccaacatcgcctcctggcaagtctgtccccatggtggccttcacggttccttcccaggacagtgtaggaccctgcttctgcctctttccttatcttgccttcctgccccatccccctactcttcaactcctgctttagcaagtgctggttctatctgtgttgccttgaccttgaaggctccccaggaccctcatctcagcttctactcccttcctcactccaaggggaagactccaatggactgaggctggagaaaccacagccagactcttggtgtggtggctaaagctggggggtctggccaatccaatctctacagctcaaatcaggaagtcaggccaggggtgctgtgtctgcctccaagcctgggccatacattcaccgcaacaggaatcagtgactttggaaaaggaatgtttccctgagtttctagaggcaggatgacccagaccgaaggacagagagttaccagaaacacacacaatgcacacaaatgtactcacttgcacacacagggtcatggcatagggagtgacacaaccaaatggcctggacaagccacagagtcccatggacacaagtgcttacaaacacaggcacacaaggtcatgtacccaaggtcaggcacacacaccctcctcattcaagtcctgcctcccaggtctggggcttgcctgtcatctgtccttaggaggagggataggtggaggcacaggagtggctcagggcaaattggtcctccacccagagactctccctttaggtgggtctggctcccagcctcccctgagatttccctggctcaccagggggctgtgtctggtggcagagagggctttggaggaggcattgccctgaaaccctggcagagcctgggcacctaagagagaatgagcaacagggctaggaagtgtgacagggagtccacaacctcccaggatcttgggagggcagggatgaggcactgagcacggcctggaagcccacgggaagcagggacccctctgtcgagggctacacctactgctctcagcatcaagcctgcagccaggtactggcaccaactcccagtgcctggcagagccctggcatggatgctaggcacagggtgccagacacgggggtgggcagggtggggggccactgggccacacacaagcatggagaccttcacacacgcaggcagaaaaatccacccacactcataccacttattttaccccctgggggttcaggggagcaaggcagggaccaccctgtcctagaggctgccttcaccgacgtccctctggcctggctcttggggttggcgggggtgggccataagtaatgggagacctaggtgcttcctctgacaccccaccctccactgacccccacacacatacatttgtgaggcaggaagtggggttgtgcgtccccaggtttaagccctggaaggaaagggaaagacggggcagagactccaagaaccgggagcggtcgtcctgttcccccgccagcccctgtcccaggcaggttttgtggccgcgagctgctcaggggtgagcgcgccttagggtgtgtgcgccagggacctggcgcagccgaccacgtgggagtgcggcgcgtgtacgggcgcgggcggcagcggcagcggcagcggagaccgggtgagcaccggctggttcctcgcggtgttcctgcaggcttggcggccgcggtggtgcgatcagcaaagggcaccgggatgccggttgtgcgtgtcctcaggtgtcccgaacaagcgtgagtggcatgtgctcacctgagcgcggcggcttggcggccccgggcgtgtgggtgggggcgcggcggagagctgaggccgggcacccgggctggaccgacgggccctctcccaagcaccgcccgcagccaggcggctcctcgagcgcagcaactttgggactttgttccggctttttccaaatcgaatctggtcgagggggcggggcggggggggagcacctgccctgcggggggtgccgggagagaagtgaaggaaagccccgcccccgcccctcccgctccccgccctctcccccgcccccggggctcttcataagctcggcccgagggcgagcagagaaagcgagtgtccctctcgcgccccaggccggtgtacccccgcactccgcgccccggcctagaagctctctctccccgctccccggcccggcccccgccccgccccgccccagcccgctgggccgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggtgagtgcgcgggtcgcggagcgcggggactccaggctcgagggcgggactggacactcaacaggactgactccccatgggcacagccaaggcgggctcctcagcgcaagagtgggagagttctccacccctgggtgcagggagcgagccaaatagggagcgccgggcacctccccaagcccgggttcactacctgccgctgcggggagtgttggagggaaagtgagacagggagtgggccggttcgagaaggaaactgactggtggctgagaagagggaacctcctggagtttgagagtttatgccattcccttccccaagagagcagtctcaggggacttcggaggccttgagaagggaggatcgttaccccttgaactctgcctgacatccccacctaagatacccatctcccattcctcgggccagagggaagagcttagatggggaacttccccaccccacccatcccccactggctgggatccttggagttcagaaaagctagaggtcaccgtgaggggcagctggacattcagctgtctttctgtctagccacccactgccaaactgctgaggcagtagtttggagcctacacccagcaccccacccccaagccctcctggtcctctgtgcccaggaaggagctcttagagagctgggctcaggtgcctctggccgcctagctgagctcctttgtctggagcagggaataaatctgtcaccagagggagggaaggggaaggggggggggggctggaggcccgccggaagtggggagggggagaaaggccagggggcactgactccattgcatcgtgggaggagcagcctggtctctcgccaatacccacggctttggacaggtgctccaggctttgtccttgcgctgggcctttgctggggcagccagcaacctggcttctcagagacctcggtctagtaggggccctgtgtgatcagatggggctgggagaattttccggaggaggaaatccttgagtggggccttggagcatgagtggagataagtggagtatgaaagggatctcggatcagagaaaggatgtgggacaaaggcttaaggcaggagtacacacggtctctgtaggggacagccagtctgggtgtgggggtggggagaaggggatatgaggtggtttccttgggaggggccatgaatcaggtaagaagccagactgctgaggcagagtaggggggaaggaggcacaagggccttgcactccagcaaagatggtagagatggggaagcattcgggctggacaggagagacccaggttccaggcgcagtgtgaagcctcagcagaccccagtttcagaggtttgaggaaggaaaatcaacagacaccccgggtatgaagtaggggccaggttgtgggctctgcctctggggacagggcagatcccttcctgctttatttgtgagccacctcaacaggacccaggccatctgcaggtactagtggcctagctgggtagtctttcctgaggtctcacctcaggcctttgtgctgctgctgttgcttctggccttgagcctgagagagaggtgagaggaaggatgctttctctaacttgggctcctccaatctctggttgcaaagctggggttgggggagagaggaccacccaacctgccctgtacaagcatcagtaagactccaagtttcccagggcccgaacacttgggggttgtctctcaacacccggctggaagacaagtaggtaaccaggttcagccccacctgccaagaacactgtgttttgggcctggcagagctgctactccccctctccctcctaagaatgcccagagaatcacttgccaaggctactcctggagctcagctgtgggatcagggtttgggctgaggatcaggtgcctgtgtgcacacatgtgcacatgtgtgtgccaatgggtggtagggattgagcccgttgtgagaacatccagccaggttggaagtgtgtacaggtatctgagggtgtgcacgtgagcaagagggtgtgcaagatgtgggtgactgttgggaccacagagctgaggcctgtggtcagctcaggtcagaactgggaggtctgtttcccttgggaggacctgtctgctctgagggggacccggacaagtgcacatatgcatgtgtgtgtctacacacacacacacacacacacacacacacacacacacacatatgcttgcctccctctccaaggcagacttgcctgggaagtacccctcctcagcaggagctcgaagacccctgcccagtgctgttttcagtagagggagtggagctgagatggggagaccgtactgagcggtccaggagtagggaaacagagctgctttgcagcttctgttccagaagatgggggttggggggcggggttgagggccaggggtgggagcaggagcagaacagaaagcctccctgctcactggcctttccccttccctcactggctgcccatggagccaggatcagcatgggaacaatcaaggaggcaggggcttatcagtactatggacccctacactggctctgcctggtggttcttctcttcgcataccaaagacagaaattaagcctccaagagtggtaactgacctcggtcacacttggtgggtgtgggaaaggattcaaatgtaggtctgttctcttcttcatctatcatggtccctgtcctggaggcaagtcgtctggggctcagaaaacacccctgttgccactgattggaattccaagggtctgggtgaagtggggatgggcctccagcttgcctccagcctgaaaaaatagtagagggtgttgaggctgggaagggaggtggggctcatgttgtacagggcctgagccagggagcttgggcttcattctgagtactgtggcagccctgggaaggtttgtagcacagagggatattgtcatttttggaaagatccctttggctgcttaggtagagaagggcttcaagagggcaggaagggacaggactacagaaggggctgcttcagagtccagattaaggaaggagaggcctgggcagtcagaaaggaagagaagccggatgtggtggcttgtatcttcaatcccagcactttgagaggccaaggtgggaggatcacttgagcccaggagttcaaaaccagcttgggcaacatagtgagactcccatctctccaaaaaaatttaaaaaccagccaggtagactgggcgcagtggctcacgcctgtaatcccagaactttgggaggccgaggcaggcagatcacgaggtcaagagttagagaccagcctgaccaacatggtgaaaccccgtctctactaaaaatacaaaacttagccaggcctgtggtgatgcgcacctgtagtctcagctactcaggaggctgaggcaggagaatcgcttgaacccgggaggcagaggttgcactgagctgagatcacgccactgcactccagcctgggcaacagagtgagactccgtctcaaacaaaaaaaaaaaaaaagaaaaaaccagccaggcgtggtgacacaggcctgtagtcccagctactcaggagaccgaggaggaaggaatgcttgggcccaggaggggaggttgcagtgagccaagatcatgccactgcactccagcctgggcaacagagcgagaccctgtctcaaaaaaaaaaaaaaaaaaaagagaaagggaggctcctactaatactgtgcctgtgcctgtgagctgtggcctgaaatcaagaaagcagaaccacactggggcctgggactgtcccagacctgacctgtgtgaatttgggaagcaacttagcattactaggccttagtttcctcttctgtaagccacattagtggggtagccacggggagtcaggcagatgacagctgtcacagagttactgcccagggctcagctagagggacacagcctgccagggatgggcctagggaaggagttagggttgttgactgctggtggcttggtttgcaggggcctggatcccatccagaccctggtgattctggggttgtctcaggctaggctgggccacagtggaagttcactgactgccctggcctggccaggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcgtgctagagttcaccaaggcccacaccaccagcaccggtcagtggcaagtgtccaccaggcaagggcgtggcaggggagtgggaaggacacggggactggaagtttgctgctgggctgacctaaggcttccctcctctgctctgtgaccccaggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggtgagtgcccccccccactggagcaaaaaggagccccctggggtgggggagggcttagggagccccttgccaaagctgagctgccccactcccaatccatccgcaggggacatgccatatccgtgcttgggggcctatggaacctccaaagcggccgtggcgctactcatggacacattcagctgtgaactccttccctggggggtcaaggtcagcatcatccagcctggctgcttcaagacaggtgggaatcagggctgggggtggggtgggggtggggaatggggctgggaatggtcttatgggggcaggtcaggtttgatgaatggtcatggttttggttgggggtgtagttttggctgcagacctggcgcgggttaaacagtcctaattggctttggctcccctagctgatcccactctgaccttgccactccttccccagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttctaaaatgcggcaggtgctgtttggagggggtcactgactggctggctgagtgacacagtgtggccgtgtgacagggtggcaactcctggggctcagcgtggaggctgggattcccctggtagactctggttcacacctccccctcctccactgacctggggcaaatcatttcagaccatgggtttcctcatagtgaaatgggggtaatgacactgatcccaattgcttgaagcaactggggaggccaggggggcctccagggccaacatctagctccccaggcctgtatgcatctgagcctccagcagaagaaggggctatctccctgggactccccaaccctgaagaatctcggctgctgactgagggagggaggtggaggcttaggcagggttgcttagcaaggtggggtcacgagggaagttaggggtcatggagaggtaccagggcctaaacgagacagcagacagttggccttagagagggcagttttattgtctcagaggggcagggctgagggagggagctgaggagcaacatccccccaggccccaaggacacacacactctgtccttcccatgggccatggctctgggagcgacccacagaagggagaggaggctcaaactgcccccaggccccagggttctcaggtcagggagttagggaggaacatgaaagtgacatgcttcttagatacatcagcggctgtaaccacagggctgagggggcctccttgctctggagggggtcttcgtccatccttggtgggggggggtgcccagccccttttcaggcctaagaacagtctctaagagggtcaggagaactgggcagccgctaggacagcgtactacaccccggacaggcaggtgagccacaggcttgtcacagaccacatacacacacacgcacacacacgcgcacacacacacacacacacacaaagagtgcaattgagagccttgggccaggacgctagaagatagggatgtagttgtcgattttggcgcggtggcgctgggcgatacattcagcgatccacacgatgttgcgacactcctgctccttgagcttcacgaaggcatagaagacaccaaagtggaactggttcaggaaggccaacttgttcagctttacctgtggacacgggcagatgtggtgtccaggtggccatggccacagagtcaggtctaaaccaccaggttggcctccctctgacaagcagaccctgcagactcacctcgtgctcaaagaatcggtcctccagcgtcttgtctccagggttgctacctgcaccctcgaagagcagcttgtactcctggccaggggggtggggggaagcacaagcatgagggttctgggtgggggtgcttggtgacaacacatccaaccgctgtcctgccagccggggcactcaccgggtagtaatcggccacgttcttgacctgttcatagtcgtcagcccgagccagctgcgccaggccctcagggtagagccgcccacagtgtggaaagagcttggcacggtcctctttggacagctctgtgccgaaagaattgatggtgatgatgaaggcgcggcggtctgcttcaaactgtggagccagtgcacaggtaagaagagagggaggaagaaggaggcagtagccagtcagttggcagagcctccccaggccagggctagcgggcaccagcaggcaggagggcgggcaggcactcacctccaggatggggcacatggcatcagccgtagtcccgcccagtagggtgcagaacttgtagaaggactccaggtaggcctgtagagagtatggagcttgctcagcacaggcaaggaagctctggagggcttgctaggcacaagccctcacagctccctcctcccctccctagcccctttcaaggtgggtacaagcacacccatggatgggccggggcagcccttacagcaaagccaatgaaacacttctgtgaatcagccaagtggcagctgcccacagcctcccacccaggagtgccagggcagggcccacccgactgtctgcttcaggctacagtctccttcaccccctcacctcacagaaggctgggctcgcaggggtcctctgactttcccctgctgctctgccttccttttccccaaatctttccaaacctccccttcctcagcctctgaaaaccaggtgtggctggacgcagtggctcacgcctgtaatcccagcactttgggaggccaaggcaggtggatcacgaggtcagttcaagaccagcctggtcaagatggtgaaaccccgtctctactaaaaatacaaaaaatttagccaggcatggtggtgggtgcctgtaatcccagctactcgggagactgaggcagagaattgcttgaacccgggaggcggaggttgcagtgaactgagatcatgccactgcactccagcctgggcgatagaaagagactccgtctcagaaaagaataaaaaaacaggtgtccgtaggctggtgaggaaaggccacgcctgaaagtccacagggatggcagggactgagtgcccccggccctctctgccaccttcccttacagaacacctcctcctcccatcctccaggcagcccctcagcatcacagagcaggaacaaaattgtcaggccagttcctgctgagggatggttattgcctacacggacgtcagctgggcacagtacaatggcaggcacatgggctgccggcgggaacaagcactccctgcccaggcaaattggatctgctgggcatgaggaaagaagaggtcagcccaggccccaggtccctcccaacgctcactcacaaaagcagccatgcttcctcccaacacctctccatgccaaggaaggtggatgatcttacgggccccatggggagctcccttgtaatggccaccctccactcagacctccctggtcccatctgctggcatgggctcagagaccctggctccacaggctagagactattcttctagattgtaggcaagggttggatggcatggaaagcttttcataccgaggtctgaactccaaggtgtggagacctttccaccaaccatcagccaacttgggctcacaagctctgctgggtggtgctccaagagagatgagatgagacccaggagtctgtgagcccaggcctgccctggccagcaatgctgggcaagcccaactcaggggaaggcctgagagtgacctctgggatcacgggaaacaaaaatctaggacaggtcaggaagtaagaagcctggaaaagagggttgaccccagcacagaggatcccaggaatgagagggcctgggtggcagagacagctgccaacccctcccatggcttggtggtacctttcacagtccctctaggggtctgtccccagccacctccttccctgtggccagccaagctggatatgtcaaaaatcccacagcctgccccagtggggccctgcacttcctatttgtgggggaaccaaccaaccaggtattgggctccatgccctgctacccacccaattgcttagccaatctgtaccaatcccaggagaggctgatcccagggtcagggaggctggtgggactctcctctggaggctagggcagctaaagaaactggcaagatcccagcaaccccggtaccaaagtcaccttcccacccccgccctgtcccctggagtctgccaatccacggctgctgcaccagctgcctactgttcccacctgctgggtggttgagggtccgcctaatctcccatctgtggtcaccgggctgggacatcgcctgacaggctggcagtcctggcacaaggcccacagcattgggtctgtgtttatgagctagtgcctgggcagccctcgccggcgactccagctagaaccagtcaggcccggtgagggcatgggtgaggctggcggacagccgcacccctcaccctgtctcagggcaggcaacccggcaacaggccagctaggcgcgtgcgtacacacacacacacaaacacacacgtgtgtatgctctctctcctctcagctaactggctggcctgtgccctattagcggagtgggtgagagcactcacttttgcaaacaagctgagccaggtgtgatccctggcgctgccagtgacttattatgtggctttaggcaacccaccctacttctctgagccttcggtttccccattttcacatggggataatgacaccttcctagttcctagcgcagtctgaaggattaaagaagctgacgaccttcccacctctggtttcaggccctctaatctgctctccacattgtggctagaaggggctttctgagaagactctgctctgttggaaacctctactggctgaccctgcccacgggactatgttcaaacttctggccttacattcaaagccctgggtaacttgatcccatgcctgccttttcttctagacttctcccctgtccatctggaatgtgtccttccacagcaaactgcctgccacttggcccatgctctatgctttccttctgcacgtgctggtcccttgccgacaccactgcaacctccaggcaggcccttcccctaccaccaaccctcactgtgctctggcccaggcccctgcagggagattggcaggcctgggctcaggctgcagccaaatgtcagccagctcgctccaaccagggcaggagaggactctcacccaatagacaggtgaggtcagcaggtccctcggccagggccatcctcagccctgctttggggcctgcccactgcggatccatgttcctgactgcagcccatctggggtcctggcgctatagctcagtgcctcaccgcagccagagcagagtctatcccagacacccctaacctaactggtctcgggctttttttttttttttttaaatttttaaactttcctctcctctccggtcccctggctctttaatctctttgggccagggtagtgctgacccagaaatcctcaggggttgcccagtctatgctacagcctggtgggaggcaagaggtgggcaggggatgaggacagtgggaagtggcactgactccaagcttgggaacctacgagggacatgaggacctagctatgcctcgccagatccctccccccaccataagtgagcacactgttgcctttgctcaagtgcctgtccttgctggcaatagcttaggtagggcggttccaggggccacggcctgggtggtagtccatgaccctcctggatgctgggggagcggctgtccaggagccagctgtaacaggccagcggtggagcaccagccactcctgctgattttatctgagcccgtcacaggcactatgggatggagaacctgttccacacagccttgtgcccagcatgggagccagagaataagcagtaagtccctgggataggagcctgacatagctgcatcctgtcccagcacctcacataaatcaccaccctaccacttcccacagccccacccaccgacaggccaatcccccatggcttgtgtggggcattaccttgtagagggtgttgcggatgatctcgatgttcatctcgtcaaggtcctgctctgaaatgcagtcctggaaaaaagccgctggggaggaaacatggtttgaggggtgggcaggtggcctaggccagaatcctgatgttcaaatgccctacacggcacagagtgcccgtgccacaaggcccacagggctgggtattgaggggtccccagcctaggctgttgccttggaagtggcagaagcaatgctctgggccatgtacactgacctgagcttctcctgcctccttgctcctaaaattgatttataaaggaggcagctagccataacatgatctaatcaccgctggggcagacccaagctcagaccatgccaaagacaggcttgcataagaggccatgacatcctcccttctggaggggcagctgtggattcggggcctaacgcctacttctctacacctcccaggaaggcctggcgtccacatttggaaaaccagcctcctccttaggacaagtccaacagcagggtaggcacagaccagcgacccagggggccactgtggggttggaaagagaggccagagcaggatagagcacccccatcccccaagagggcctgcagactcactggtctatctcttcattaaagatggagaaactgaagaagccacaaacagcccagaaccagctcagagttgctgggagagcctacggcagacaaggtcagcaggtagggctcaggcctcttagctcagaacccagtgcagcttagagccctgtagttcaaccctggtggcttcttagaggtggtaccccaggcccaggactctggctacaaggacacttaatgccttctcctcggcctcctaagcaggcaggaactagcactgcctaagcagggctctgcaggaagctcttgattccccttccctggcttctgatacggaccttgcatcctgctggatgctgtctgacctggcccaggggacctgctcggtggagggaagtggcagtgtttgcttcgctccttgcctcacaggcagccactctggctttactcaggctccagctccgggccacagtctgtcagagctctcgggactccaagggacttgggcctctctcactcttctccatgagctcagccctcctctgcactctgggagatcagactgcttcacaaagtgagacagtcccagtcaggccctgggtagcctgcctggcccagcaaaagcaacaggacaggagcagaagaggggtgaagtgaggagagaatcggaggaggaagttgaagggagacaaaggtaagcagcagtgggcaggtctcactttctggctcagggtcgccccccagcgggtccacaaaccccaccctgatgcgctgatgctgacaccactgcccacctcccatgaccaccacagcggctcaccaagaggcgtgtccaccagaatggcattgtagagctcagcaggtgtctgagcaatgttcacggcctccatctgctcgaagctgcctagtgggtggcacttgggcacgagctcagcgatggagcgctggtgcagcgtgcctgtgatgagcaggatcacgttgtcgatcatgtaactgtaactacagggggcaggcaatagcaaggagcccatcaaggtgggggccgggaagtcctggcatagcaccatgccctcgcccgcctgcacaggccatcaccccttaacaatgtatgctgactcatgggtgctgcggataagcaccagtgtctcctctccctccccatgttcctctcaagcttctgaccacccccactgccagaggcctaggacagacacaggccccccaaacgggcgggggcaggggattcatgccctgtgagggactgggacacgagctaactaccccacagcatgaacagtgttctaacaggacacaggaatggggcacaggaggtgagacatgcagcccagcccagggggtgaagagcgtgagagcctgggaaattaaagggctgggagaagaaagtgtgttctgggaagagggaacagcatgtgcaaaggcctggaggcactcactgagtgacggatgcattggaggaactggcatggtcaggactggcagagggagagaaaggcgcagcagccggcagcacggggctgcagcaggcggggggcagaggctgggcctggagggccctggctttgttttgagcactagggatctatgagcagggtgtaagcaggggaatcgccatccagttagggtcactctgtcccccagtggggacagaagaggaagaggcagagatagcgacaggaggaaaggctgaggagtggagtggagagaagcttctccagggaaggccagcaaggagccagtgggggttctctggaatgaaggcccaggtcaggcagacctgcacagcctatgccagagatagagaactgtcctcttcttttagggcctgaggccagggctgggcattcacccaggacggcctggataagacccagagacctgaacaggaggctgggtcaggtcgatcccaggccgaggctcccatcactctgccctgcagaaggccagctctgtggggtacatgggcagcagagggggctgtggagctggggaggggtgagactgcccagttcagacttggcaagggacaaggctctgcctccaaccagctacaaaggggctggggcagagagttctgtgtagtcacctgtgtggggatgcagtgaaggcagtaagccccattccacagttaggctgcagtagccacaactatcctccagtctgtcaccaaagatgaactcagggtatgagggagctaaatgaggcctaggggaaattcctccaaggtcaaggtgaggcacctatgggataaaagttggggtggaggctgctgttctgagctgggcactgaacacgggtcttgtcctagcttctgagtgggccagagctaggcccctgccctgtgacaggaccttgtgcaactagtgctcaggctgtccagagaagaccttggtaggaggtgtcttcccccatactgaagaaagaaaggaggggaggtggcagcccagggcccaggccacggctcaaagcactggccactgggggagctcccacagggccctctagaaaggcggcaggaggaaaaggccccagctcctgtcctggcctgacccccactccccctgcttgctctgcactcccccagctcccacccagcctggcgccctgcgaagacctttgctctcctgggcctggagccaggcaactgccctctctccacccccaatctggctgggtcagctacaggatgtgcactgagaagagacagtcccctaactcccaaccataactgagagccttaagcagggcccacttgcagctgcaagccaagaggcccaaatgggcagcctcctgcccccaaccccacagtgctggcagagtgagggacctcagagctcgccagagctttgggccatggtctgcagctccagcctgcatattttctaccccggacagcacacacgcctcctgcctatgaggcctccaacatctcacataccccagaacccatgctgcatatgcgccaccccgcaatactctaactgcaccccatccagccccaatgtagccttggtgctccctgagacagtcacaaatcccctgcccccaagcagaaggatgctttcttatgctctccctccctttcggacgggaagagggagaaaaagcacacccaaggcccaccttatccaagtgatcccacaaccactagcattaccagccccactgtcagagcagataaggcccagagagggccagcaccaggccctaacacaccacaaagcagaggagctccacgtccccatggccaatgtccacacacctccacccatgaccagggccccctgcctggctctacataccccacctagtctcattttctcagagggatccccaccagccaatctcctctttttcaacgtccccctccttgcgccccccactcagggcatctgtttatgtgggggaaatgctgagcctagtaagggccactcacaatcgcactaccccagccccttcaaggccctcttcaaacccaagccaggccaatcgtgggcgatcctgtgccaggcccagcacttcccttgccgggctggctataagcttgttgctgctgcagccctgcttttctctcctgcccagtgaggggcagaatcctctttttcaggagatgagaggctggacaggcctggcagagataaggctggcccagcagtctgcctttctcccaaggccgaggccttcggcaggcagggaaatcctcctcttcctccttgcctggcttcagcagctgcctccctgcccccagaaagccactccaccattcctcccctcatttggcctcaataggagggaataaggttccagctggtcagcatctccctccaggggaagacagctggggagtggagggccggctgcccgccaggccaaagaggcccttgtggggtgggggtggggccgtctgtattcctctgcccagaggccctcccttgccctgtgccttcaaaactcagcttgggcccacagacatcttgggttggagtttaggaagccacttcctccaagaagccttcagagtccctagccaactctgcccctctgctgcgccctttggtgccacctgctggaacaatatggcttctcaaccccgggtggctggtctggtgctggtgaggcagccatgatgcctgggtaaccctgccagcctgtccactgcagtccccagcaggtgctccagtgagctgctaatgacagtatctgtattcaatcacttctgggtcctgaagagccctgtgcagagtggaaagtgaacagaaatatcactgtttctgagctctgtccatggcctcagcacaccacctctcgagacttagtttctcctccatatcaagatgagtgagggccaggcatggtggctcacaccagtaatcccagcactttgggaggcagaggtgggaggctctcttagctcaggagtttgaggccagcctgggcaacatagcaagacctcatttctattaaaaaatcaaaaaaattagccaggtgtggtggcatgcacttgtaataccagacacttgggaggctgaggcaggaggatcacttgagcccaggagatcaaggctgcaggtgagctatgatcatgccactgcactccagcctgggcaacagagcaagatcctatctcaaaaaataaaataaatagaagatgagggtgggtgctgtggctcatgcctgttatcccagcactttgggaggccgaggagggcggatcacttgaggccaggagtttgagaccaccctggccaacatggtgaaatcctgtctctattaaaaatacaaaaattagtcgggtgtggtggcgcacacctgtaatcccagctgctctggaggctgaggcaggagactcacttgaacctgggatgcggagcttgcagtgagccgagaacgtgccactacattctggcctgtgcgacagagtgagactccagctcaaaaaaaaaaaaaaaaaaagcatatgagtgaggtgtggctccaacagagatagtgagctttaacctgctcataaaagtcctgcctctccccaaggcccagttgggtccttccacctggtctgagccttctgggcctcacggagctcctgcatgcttgaccccaggagaagagtgaaagtgctggcactccttcaaggcaggagccaggtctagcccaggaccctgaaaccacagcaggcctacagcccccaactgcagagtcctgccatggacccagaaacagtgactgtagatagcaaagacaggaactggccaggggagtgggggccagaggaacctgatgtccctctgtgaccaagcagggccccaaggttggggtgacaggtcctggagaaaatcacagatgtgctgacaggcccattaggcatttgaggccactgtcctgggacaaagcctcttaccagttgcccactccaggctggtggcactgaggcccctgacacaagagaaatatgggccctcagatcccccaggtggtgcaggttacccatgcccaggctctgccaatgggcacctgggctaggccccctccagggaggctcactcattcaaagacaaaggcctttaaagcccacctgggactccccagaggccgcactcactcctcccacaagtctctcagcatgtcttctaggaccaactctctcaagggaaaacatcatggaatggcccagatcaaagtcccctccaaggccaaaaaaccctgacagacaccatcccaagtcccacagcaaggtaatgactgggcttgggcatggtgacataacaacatgttagtggcatgaaactgagccagatcctctcaagagcacatgacgacagtctacttcaggggccctatctcactcaggctgtcggccccatgccagacagctgcctcatgccagacagctgcctcttctccagccacctactctctccagtggcttctctatccccacctgatcctggagtcctcccaatgctgtgaagccacctgtgacccccagttccatttgctaaagctgctcacagtcctctccaggcactgtctatactatcactggtgccatcccactgcatccaggcacctccctcccagccccaggcctggcccagagcaggtactggttatgtgtgcggctgaaggctggccaggacctacgaaagcagtggacactgtctctcacacagaagggcagaggcagcctcagccagctcctgctttcatcacctcctggcagaagcctgctccagccagcctggggcagctccaaaagcaactatgaggccctgagggatggagctaaggtgacctctgtaatggtcccaacctctgtccctagctgggccaactttgtctgtgggcagtcagggcactgttccctcaggtcttcacacccaggacagggcctctcgctgatgcttctactgcctggaggactgtactctcctgagtatattcctctgcgttttctagggtagcttcctcattcccagagtgggcacccatatctggaggctgttgtgtggggcacagagccaggtgcaccatgctcgctactcaggacatgtatagttccctcaacctaaaaaccccctattccaatgcttcccttaaatgcttttcccctcagccaaactagccacctcctcagggaagccaatcgtgagccccagcctgggggagctcaggcctctatggaaggcttcaccccttcctgcaacactccacacacacactggggatggcctgctggggcagagcggagaagggagagtggccagagaggtaggagttaagtcagagaggcatcatgggagcaaagaaatagctaggggggctggggggtggacaccgcagagtggtcacgcctggagaccttggctacgtgaaggtcaggggtggctttagccagggccttgtggtggagtgacgggactgttgaaagctcgagggatgaggggaaatgagagaacagacagtgaatgtaaaagtttaggtcccacgagatgttttttaattatttgagcttgcttagatactgaagagaagaattcggaagggaaggtgcctgcacagacaggaatgcaaatgagtggccactcagcatccagggagtaaggtgagggcactcagaacattggtggaaggatccaagagaaaaggaagggcacttctgccattggaatagggttcgggcggtggggggcagaagcagcactgggaggcatattattggcttccactgtctttgtgaagaaggtgggccacctgcccaagaggaggctgggggcaggagagcaatggtgtttaagacgggaaggtggtctttgcagtgctggtggggtctgcagggtgctgagtaggtagagccagaggctgccaggcagaaaaaagcttgaggctggctaagagggtgagcatgcaagcctggcagcaaggatgaccccccactcaaggctggcttccccagctttcctcccggcagtggaggtagggggagagcggctccaggctggaggctgctgggattcctccagggctggggggctgccagccgggtgggaccatgagtcgggcggccaagagagctgcggatgttggcagaaaagtgctcgaatgatggaccagggaacttcagttggggagggcgggaaatgaagacagaaggggtagcaggggaggaagcaaggcctagtgtcccgctgagtctggaacccgtgtcccacaagggactgagagtgggctggagggcctgaaggctgtgggtagagaggtgcctgattcagcaatttcaggggtggagcagttccaggtggtgacatgggcctgggcagccatcagtggggatggctgaagtgcagagcagaggagcaaaggagcaggtcattggagatgacgaggtcatggaccaagcagacacaggccctgatgggctgacacgtgactgctgagctccttctgagtgaggggaggagtgagtggctggtaggactggaagccacaatcacccatgaatggaaggggtgggaagtggcagattcggacagccttccacaggacagcacttggctgctttaagcacccttggtgcttgcagccaacctccagctgtggttgtgcagcctcagtcacgctcagagccctctccagtttcatggcctggcaggctaagaccaagacaggccaaaggctagctgcacaggcaggtgggccagtgggcagtggggtgggtgatatctaccctctgaccatgggcatggggtcaggcctcctctggccagcctagctggcaaggccagaacattcaccaggaagctgaagcagccttgtgcaaacaagtctcaggctgggctctagcaataaatgtactgcttcctggtatgtcctcagctctggctttgcagcaaggaacacagagaccaaggccagggaatgatcaacagatggggagctgcaatgtgacccctaatgtagcaccacaagagacaccccattaccagcctcctgccccagtaggtccatgttggcataccttgatggaggccagggcagcaaggagactctcaggaaaggaggcctgtggccaggagagggcctgcttcctagcttgggcatgttccctggcccttcaggtgtcccagcctctgactcctgcctgagaatggagccctttggctgcagcacttcttgagcaagtggatcctgggcaagtggctcctaactgcaggggataagaatcaggccaggcagcaggcatctaactctgtccctgcagggacaagtggggcaggtgtgccaggtcccaaggaaaagagtgggggcaccataatcaaggaatggtaaaagttagacaatacccagagagctcagggaaatgcttcaccatactgcacactcacactctgccaatgcagggtactctcctagacgctagccgctgagcatgcctctgctcaccacccctgtggggccaccacctaggctgggactatttctttgtccaccaggacttggctcatggctcttgggacatccctgcaaagggaccctccctacctccctgtgcagtccaggtgccctccccgtgcagtccaggtgccctccccgagcctgcagatcccaaggtcctttcctccactcagcttctccaggagcttgatgaaggcagagctgtgcccaagggtcagacaatgaagaagctggggcagccaagagtcataagaatgggagcctgcccacctgagttcctgagggcttgcgtcagaactgagaaaggcagctagacgttcagcctgcccctcaactctactccgaaccaatctccctgagacccagggccatggtcagagcagatagagaatgggcctatcctaagaccttggcctttcagagctctgtccatcccgacacctgacccctcgcatggggagtggggcctggtgagtgttctgtttgggtgctgtagggtaagaaaaagggctcccaccttcccaggtttccctgccccagtctatgtgactgggggaagaggcttcatccagcactactgcgtgggacactcttgcctgcccatcatatcttcagccagtagtgaacgtgctggtgacccatttcataggtggtggcctggaagtccagggttgttgaatgaccacgcacacagtcagggaggactctgaaggtagggtcctgggacacctggcctgacagagctgccatcagctctgacagctgacacaggcacgaaggcagctagcctaagccacactgaacccagctcctgcaggtgtagctatcctgcccaggtaagagaagaaggcgctacaaagcacactcacgtaatgaagtctaggaagctggcgagtggctcataggcatggttcctcatgtggcggaactccaccaccatcttctccttgagccggtcatcgatgactgacaccgtcagaggtgatgcctcgttggccaggaagttaccataatcagtgctctgcagatgcagtttcaagtctgaaacccaagggtagggggtaagggctagccttgctgggcctccccaagggtcccaagtccccatccccaccccaactcagccccagctctcccctgcagttgtgtcccgctactaccctgatctccatctccctgttggctcagggcctaccacagggcaatcagctaaggccctggagatgcaccagatctttgggccacaatccagcacatggagccccaaagttcgagcataagaggaacagttcctccccaagatgacaagaaagcctgggaaattccaaggtccaatccacaacccacagcctttgaagcccttctgtatgttaagctgtaggctggccctaatctagagcagggtaagtcatgagccctgcactccagggcctcagggtcagaggggcaagccaacacaccccgaggcacatgaaatacaagagatgcctgaagctgtgggagtggagtggagagggcaccaaagatcagactgagaagatgagaaggccacaaaaggctgggccacagcaaagggcaggggcaagaaagtacaaaggaaacagccaggaggatggtgtgagtgacaagtggcctgcagggcaaatgagtggcatgcgggggaggtgaggctggcaggaaagactgagcgtcccttcagagtggccggagacaggcagaccaatcctgagggttctcttgagcattcagagatggggtaagggaaaaggaaggagaggcagagcagaagggcccgggggaagcaggccaagggagaggcagtgggatcctgatgagaacctaacaacagtctcccagagtgttttgtttttgtttttgttttttgtttgtttgtttttttttttagagatggcatcttgctaggttcccaggctgaacttgaactcctagtctcaagtgatcctctggcctcagcctcccaagtggctgggactacaggcatgtgccagccagagtgatctttttaaaacacaaggcagaccatgccattcattggccttaaactctccgctactcctactttactcagaaagagtcccttccagagccctcatgtggtggtcccaccatccccgcttaacctctctgacttaggtcctgccattcccccatgctcactatccccagccatgtccccacctcagggcccttccccgtcccctggcctgaaagtggagctgtctccccctcttccttcagatctttcctcacacgccccctcttcagaggcttctccagcagcccatcactgtcccttgtgttattcttcttagcagtacttatcccacctgatacaggacacagaagctccctggggacagtaccaaggacagtggctgagaagatacccaggcacatggtggcggaggctggcttggaagactacatgcctctctgtcccctggggaggctgcccaggggatcaaaggcggagctgcacttgggaccacctccacacgctgtcctggccacggcctccccagatgtctttgaggctcaggagaccatgctagcctgggttgtttagagaagaagggaagtggggcacataaaccctctacaagcttaggggacccctgtgatgcccctcctgctgtactccatcaggagaagacagccccaacctggagtcaggcgagctaaaggagagatggaacacagcatgttggaatacagcaggtctctggaatagatgccttccacctgcatctctggggggctggtagcaggccacactcatgacctctgtggctcctgggcactcatggagtgaacttcaacctcctgaggcctgcaggagacacctgctgccttcaccattactctgcaattgaccactacttttctcccatggccacccaaaagggcatagaagagaaagtcaggcagggcaggcagaagccaccagcccctgttctgctctgtggaccccaatgcctttttgcctgggaaatgtgcactctcctacatccttaccccaggccgtctgcaatgaacccttgccctgagatctcttctcccacatcctcaccacatctaaccaagccccagctactcctagagtaaggcatgggtgagaaaagatgctttgctcagtaaacttgggtggttgcattatttcattacccatttggttgttaactgttcttaactgtaattgatggtcattgctgaaataatatattgcctgtatttctacctctagaaatgggtttcatgtgctagattttaatatccttgagcttgggcaagtatgcaagccttttttttttttttttctgagatggaatcttgctctgttgcccaggctggagtgcagtggcacaatctcggctcactgcaacctctgcctcccgggtttaaacgattctcctgcctcagcctcccgagtagctgggactaaaggtgcatgccaccatgcctggctaatttttttttatttttagtagagacggggtttcactatgttggccaggctggtctcgaactcctgacctcagcctccacctgcctcagcctcccaaagtgctgcgattacaggcgtgaaccacgtgtgcaagtctttttaagagaaacatggtttatttgtacaaaactgagagattgttaatgcccctgatgtggtttttgtggatgtgaaatggtaagaatattaactggttcctcttactgtggtattaaaatgaagccttcttaatttatcaaagtcatgttcatgctctgattttatatacttggggttctggcccaggcccagcaagtgctgaaatctccactaggggaagctgcagagcggatggcagctgggagccaagactggaatacagttctctgggtcagacccaggcactggtgcggcagctgccagaccaaacctgtctgcttattcacacagccactgcagccagccaagagcccttctcaggccaggagacttcttccttttcagctatagcctgggcctagaggccgggccagatgtacagggtgagctccagagaaaaactcagtcctttgggtggtggcactcctgccagtgactccactattccctgggactgggagtctggaccccggtctggcctcctgatccctcccctccaaagcatcaggggctgggcctcacccgggcatctgtgtacacactgctcttccaggccctggcacaagctgctgggaggcttccccgagtgagctgtcacctcctactcaggatcctcatgagctctcaagcagcatgaaacttcctctgctccagcctcccactttgctccacatggcttctctccctagctcagcaacttccccactgccaagcacctttcccctccctaggcctccatgactctctatccaacacctgggactggccaggggggagtcccctcatcccaacatgaagcgggcaacccagatctactctaactggaaacacatgggctgtacggtgtactcatccccatgccaggagcaacctgtgtgctggacctctcaaccatgcccatctcagcctcaggaacagaaatcagacagaacatgaaacctgtccagagtcccagagttggggcatagaggggctgggatgtggagcaggcctgggggattctatctgtccccagatctagtttcctcctctcctccccactctgcacctcctttaccgctctattccccagcccttgacccaggacaggcttttcagatacagactcagctgtccagacagatttcagtcccagatgagctggcaggtggtggcagaggggtgggagaagccagggcatgccttcttcccctcctcggaggcagcctgaacactcactgctcacctgacaggcatggaccatcagcactgtcactggactgtcatcactcagggacaagtccctctggcatcccttgtggcaccatccattcctagagaagccaggaatgtgtgcacgtgaatgagggggcaaagccaagcagagggctctcttctgcaggccccccactcctgggctcagcaagggcctccaagcaaacacccctgtgccttggctgctgcattctgctgacactgcatctggggaagccacggctccaagcactgctggaacgcaggcggctgggtggtttctgctggcatttgtcagatcagagcaaacccgggagactctactgagaatcctgcccaaggcctgaggagtcttccttaccaggaaacttattttttaaaagcccccagggacgatgtcaaagggccgttccagaccactttccctggccaaaccccacatctccctgtgacccagggaagggggacagcctgccagccaagaaggcgacttagagaaggaggcctgctgaaccctcagctcacccatgaggagaccacacagggcttctaaaccagctctggccctgttggagaaacctggctcccagacccagtggctggcagccccaagccctaagacagtactggtcaggcctaggacaaggctggttgggatgctccctcctccccagcttcctgctctctctgagggatgcggaggaggggatgtgactgggaggggacgtgactgggagcaggatctaagcacagaaggagaggcctggaacttgttgagagctttgtgggagacctggccacccagccctggcccagcctctgagggcagccaaggacggcaggggctctgggaagccaggggctagttctgctctgggccttgggctcagcagcctgacagcctcagtgatggccactgagaggcccagacgtgcccagccaaggcatgagcaagcagtgttctggctagcacagactcgggggaccgctctggtctacccacaagcccagctgtctaccccaaatcctcccatccatggcccaacaacaggaatgtctggccagcttgggatctctcacagtaaaagacttccttgaaggctgatttctcatgttcaaaagatgctgctgctctcaggaagttctctctgctgtctgacctgaaccccaactcagaagcagcagaccaacttggtctcccggtatctccagccttccctcaggcctaggcttgctcctcagtctgcaccccaggaccttcccacaactcctctgcttcccacattcttgtccccatgttcagatgactctccccccagctccatctcctggcactacccaggccttctgccccacatcttggctccctactcccaagaccactctccataccatcaccagaatgaagtcctccaaattgaatggttcgctgtcaccttcacccagcagtccatgtagccctgaagctggagttctgcctctcccccacagcctgtgaggccccgtgccctcagccctagcattacctcagcccttgactggtctaacagtgctacttgctggccagagtgaccttcctgtgatctctgctccagcaagtgctccagggaagtccacaggctgccggagagagaagcccttgaagtgcaggaaatagtgctgctttctcaggcccatagagaggctgggttgggaagacacacccccagcctggaaagtgagagtccctgccctcccacctccacaggccggccctgtccaccctgaggttgcctgtgtcaaggaccattgccctggctccagcaggggcagctgaggtctttgaagaggcctgggaaggctgcagcccaagacccacctggcatggctgcccctctcaggggtcgccaggctgcaccagactcaggctggccacactgagccccagctggcacccctatcaccctagcccttgattaataggagggcatgggacactcagcctgcccagtgctttctgctctctgtgtgacaaagtatgggcttggcagctaaccccagacaggccttgagaggtggcagctgggcagccctgcccccgcccacttcctgaaacttttcccagatcctgccaacccagaaggggatctttcagcctctccagggctcccaggctcagatggcacacggctttttcagcccccaggcctctgcagttcctccccaagggccatagggaggcagaaaggagggtcctggcccgtgccagggggttggtcccacatgccccagggcccagtaggcatggaggcagcccctggccagcatactgggcggggcagacccgcttgaggctcccccatggcctcatggccggcccatggaggggtcttgctggccagctggccacagcacagtgtgagaggacagagtgttcccagactttacttctgcttttccagaggtcactcagtgaggctctcctggggagctcaggggttttcaggaattgaggcccactgaatggaaccagatgtgagaacatgctccctagactctggtgtgcccacaatgccattctctgcaagggtggcagagtcttggagcctgttctaccactcccctgggcctggctgagaagtcggcttcgaagggactggacctgggctctacctccaatgctacaacttctactggctcaaagtaggaaaactcagacagatggaccaatgtggacagatggccaggctggtggcccaacaaagcgagagctgccctgcccctcctcggtgaatgtgctgcgcctgacctcctccctaggctcaggagtgggaggagaccttttttttcatatcagctccaaagcagatgtgtgcactggctggctggatctgcagggtcagagcaccacatctggaactctcagtgtgggagccacagcatagaaaccattaaccctgggtttacctggggcctgcagcacagtatgagtgtcctcttcagcccccaggcctctgccagggcccttcgcaggctctctgcaaacctcacgtaacaccaattgactgagtaaccccaagttccaacacttcctatcaaatgccagctttcccccctccccccatgccatctgccattccccatccggaaccttggcactatcaccctcaactggggtatccatggcacctttccctggccagtgcaggcccacccatcacccatcagctgatccatcccacagccccagccccctctgcagatccattttgccagatcactggcttcaagacattattccttaggcagctgagtgggacaggggagaaagaatctgggcttcagagccacaaggacctgggttcaaatcctgtctacaaattggccctaaaacacttgtggaatctctctggaaccaggcccctggccagtcaccaggtaacaggttctgcagtgccagcctcccagggcactgcacagacactgagcaaaggcagcggtttacagagagctgagcacagcataccacagtccatttctcctggcagacaccatgagcccagcagtgtgtagccttgactccaggctgttgcttaggctgtcctactaagtcctgtacagaaggtacctgttcctcctctccatggtctgtcccaaccctttcccaggcctctagcatgctgtcctccctgtcataaagcctgcaggggaccttgtgcagcatgagcatgctaacactctgctatctcctggggaaagagaaacagggctggctcaagagccggggcttctgtccccaaacctacatctcacctatcagcaagatcatagagagctctgagcagccccagcaacctggatagagagaggcaaggacagaactctgcaccacccaccacaccctgagttgccctgagggtctcaggagcaggtaggaggtagtatagccaaggacagctcttgcttcatgggaaacctctgggctggcaggccagtagtcttgggaagaacctggagtctcctgctggcacggtcacatgcaagttactaggtttcaggtggctaaggcagagctcctgcagggaaaagacagtaagttctccttcctcggtccctggacctacattttgtttcatgctagaggtttttcagtgaggtgaggcactcacagtaggggaatggggccaatctgcagagatggtccagctgacaccaggggccagcggcaccgaccatcagcaacatcagacacagggatcaaatgggagagtcacctcccaagtccaggaagcaaaaggatgtctgccctgggttcatcaccccactccctgctctgggacaggtggtaggtggtggcagagacacatttaattaccctcatactctcaggaacaccttgtccctgaggctgggaggatgaaagcatttctcacatcctaggaggaagtcaactcgtttgacagtcaggagggtgccaggcaggcgacagtcccatgtgccaaagggaggggcagaactggttactgctgcacccagggcaagttccaagaagctctcctctgactgagtggagatccgcctggacagcccgtcaccaggccgtccccacccaggcctgaaggctccatgggactggcatgtcccaggagacacagggcttgcagggcagctttcctatgttccctggccacagcccagcctgagaatcagacaacccagcctcaccctgggaggtgggggccacaccctcctctgttgatgccctgcactttgaccgaagcaagctatttcttctccaggtttgccaccacggttatagaaccggcaggttggggtggatctggaactgtgaagaagagcttcttttcattttcccaaagatgtgagtttgcctgggcatgagtaagaggtaaagtggtctggcctggccagatgccaggtagcccaaggaaggccagttatggcaatgtgctgtgctcaaaagctggccgaggctgggcacagtggctcacacctataatcccagcgttttgggagaccaaggtgagggaatcacttgaccccagggagtttgagaccagcctgggcaacatagtgagacctagtctccacaaaaaataaaacaaaatgagcccagcgcagtggtacatgcctgtagtctcagctacctgggaggctaaggtgggaggatggcttgagtctgggaggttgagactgcagtgagccaagatcatgccactgcactccagcctgtgagacagagggagactctgtctcaaaaaaaaaaaaaaaacctggcccatgcccatgtctagcttctgggtctgctggcctgcaccacctgagcaatcctgtcagctcttgatgctgggctcctgttccacacgcacagccatcttcagaaggacacgaaggaaagttggggctcactcagttggaggtggaggggatttctagggctccctagaggtggctgttctcagtgagaataagcaggtcaggctggatcctggcaggagcatcctgccagttccacggtgcctagagccagcccaaaggagaaaagtaggaaatactcattttgctttgacctaggccctgtgtttgggctcgtgggatcaaacctcatctggggctgtgagctcatgcactgtcagcataaagtcccattccctgcggctcataaaaactggacagaggctgggcgtggtggctcatgcctgtaatcccagcactttgagaggctgaggtgggaggatcacttgagcccagaagctcaagaccagcctgagcaacacagagagactctgtctctacaaaaaatacaaagattagccagatgtggcagcatgtgcctgtggtcccaactactcgaaaggctaaggtgagaggatcacttgagcccaggaggtcaagactgcagtgttcatgccactgtcctccagcctaggtgacagaatgagactctttcatgaaagaaacaaagaaagaaaaaagaaagagggagggagggaggaagaaggggaaaaaaaaaaagaaagaaaaagaaaaaagaagaaaaaagaaactggacagagcagcccaggccagaggtagagttaatccatcccatacctttcgctggcagagccaagaggcttggtccaggcaagaagatggcagaagcagtaactatacaagctggtccagtacagcacccccaggaccccacccaccctgcctttcagccctcccctcagcggccctgctcaagggccttgtgggacaggtgcgggggcaacagtaacatgccagagtgagccagtgctgtggacctgggctggcccctgggagggacgtggtcacctgcttgaccacacagtggaagctaggtccaaatgactgaagccactgggggaggtgggaggcatggagcctgggcagataccgaagggtgacattccaggaccctgtgctctcccaggccttgtgatatggtatctagtttgaaggttaaagggttgggggcatgggaaaacaggcagagctgaacccatgacctggcagcctcagggccttgtgtgctacatcatggactgcagctcatctgtattcatcagctcccaacccttcaagtttcaagctagatcccatgtggcaaggcctgaggaaaagacaagggccccagaaacagggtcctttttgcatgactacccgttcctgagttgggggccagttcacagagatatagtccaggcatccttgagtgaacaaatggaagaatagataaagggggaaaaaaatcaaagaacatagagtgattggtcaggaactgccaagacaggtgtcaggagaccataattacgcccttgggccttaccttggacccagcttcccagatgaagagagctggataacggtacctccaggagcctgtccagctatgacactgttctagcctcgtcaggcccagaccacattgactccctgcaacccagcccctgagggccactcaggggctcccagtgagaccagtggcctggatacccatggaacagcctcagaagaactgatgacagctgcaggggagaccctggggctgtggagcctctgagtggccaccagcacagggacaagggcaggcagtaaaagctgagtttcagatgactcctcagagggaaaagccccatccaccagccaagcacgaaagcctctgttgaggtcaaggcctgaaaaccattgcctgagcatccaaagtggggcaaggtctgggcaagtgcccagggccaggcaagagctggccaggaaagcagtgtccagcaccagtcagggctgctcctccacatattcctttcccctgccaccaatctgcccagcggtcctcaggaccacacacattcacacaggggcaatcccagcactgccccttgtgcctactccttggtccttcaggggagttgctaggtttggacacacagagcaggtgcccaggccacaaagcagcagcctagcctactaaagcacccttcggggccttgactttcctgcctctgaaaaggaggaagaccaacattctagtgcaggatagattttttaaaacatcagccagggagtaggtgttggatgaggcagacgccaaggagcccaatggagaggcctccaaactggggtacagggtaggagagacttgtcaatcaactgataacccatcgccagcctgaccgtgtggacctgcagtgcttacatggtgttcaggtgcctggtttggccatctcccggagtcaccctgcatatatgtacctatacatgccacatacatcctacatgcccctcagagggagtgccaaatgaggttgaggagagagaaaaattcatcctctgtcctgaagacaaattttccctctcctggagaggccagggtggcaagacaagagtggtgactacctagggaggtgcatggttctaggagcctgagaagtgtagccctgatccctgggctgcctcaagctcctacttggagctcccaagacccatgggttcatagcacactgtgctgtacctgcagctccaactctgagctgctggcatgacccaggtgagggtaaatgaggacggtgtggtgggcaaggctggagcagcctgcactgggcaccaaggcaaagagcatcaggaaatgtcccctggccttctccttcccaacccaggaagatagggcacagggaggtgaggatgggtagaggtacacagacaggagacactaagcgacaagccctacctcatctgagaaggccaactgagacttaagtgagggaagtagggcccagagcagagacccaagggacagtgctggtggcagctgccccacggaaaagcagagagagagcctggatgactcacggggtccagccacacctccctccccaggctccttgagaagtggagtgatcctggcgcacccccttgtggtgggaggatggcattgtccacagcgaggggcccctctggtgggaagagggtacgccagctccagttccccttcaacacatccctccaatttaatcactgcctcagactcctggtcagcatctcccagtcatcaacctctgagggagtgggactacaggtacccacagagctatgcaggaatgtctcataaagaacaggagttgggccaggcgcggtggctcacgcctgtaatcccagcactttgggaggccaagatgggcagatcacctgcggtcgagggctcgagaccagcctgaccaacatggagaaaccctgtatctagtaaacacatacacacacacacacacacacacacacacacacacacacacacacacacacaaaattagccaggcatggtggcgcttgcctgtaatcctagtactcaggaggctgaggcaggagaatcacttgaacacgggaggcggaggttgcggtgagccaagattgtgccattgcactccagcctgggcaacaagaataaaactctgtctcaaaaaaaaaaaagaacagaagttggccgggcacggtggctcacacctgtaatcccagcactttggaaggccgaggctgaaagatgacttgagcccagaagttttgagaccagactggccaacataatgagaccttgtctctaccaaaaataaacaaaatcagctgggcgtcgtggtgcatggtttgcagcctaggtggtcaaggctacagtgagccatgatggagccactgcactccagcccaggcaacagagtgaggccctgtctcaaaaaaaagaaaagaaaagaaaagaaagagaacaataggtggatataagcctggaaagccaaaccggagaccacacagacctgagtcggtcataaggaactggtctgtcttgcatgagtgaagacaaagccttcagagggacaaggctgaagaggacgtggagggaagcatgggcatcctcagccctctacactcttgctctccctctcagccagaccctcccaagtctccaattccctttatctaagtctcaactccttttgtctctactgcctagtatgtgtctaataaaagcaagtgcttaataactcagaaacagggaaatctatgatatggtgcatccctggggttggggggtgggagacttggcttttcctcccccacacccccaaagcctagtactcagccagtgccagtagagctgtcatggctgggcacagtggctcatgcctgtaatctcagcactttgggagaccgaggtgggcggatcacgaggtcaagagatcaagaccatcctggccaacatcgtgaaaccccgtctctactaaaaagacaaaaattaggcgggcgtggtggcgggtgcctgtaatcccagttacttgggaggctaaggcaggagaatcgcttgaacccaggaggcggaggttgcagtgagccaagatcatgccactgcactccagcctggcaacagagtgagactctgtctcaaaaaaaaaaaagagctgtcactcatccaatcaggcaaatatctattgagcatccactctggctaggactgcgctgttgaatccttacaacctacgagtaagtgatttctgtttcattttacaagtgggcaaatacatctctgcatcacacagctgtccggaagggagccatggtctgcctgatgcctggctccacacagaagaactcaagaaaggttctggcaacccataggggcactagggtcctgaccctgagcaggcgcagatgacttagagacagtcatatcatgtccttgcacctgttcattctggatgcagatcctcctaacaagctgcagtgtgtctgatcactgagctcaaagcccaagagcagctacaggttgggaaggggaccctggtgctatagcaggcatcctgaccacagcaggaagagtgaatgggtggcctgacagaaggccagggacaaaactatgggaggcagacctgggccctcagggacagtggttctgttccatctcattccaagtctaacagccgttaatgcaggagagactctgctatgttcagtgtatgccacttaagaaagcagggagcctgggcaacatagtgagaccctgtctccactaaaaaataaaaaattagccagacatggtaacacatgcctgtactcccagctacttgggaaaggtgaggtagaaggatcacttgagcccaggaggttgaggctgcagtgggtcatgatcatgccactgcaatccaacctgggcgacagagtgagaccctgtcttaaaaaaggaaaaggagctaagcgtgatggctcatgcatgtaatcccagtactttgggaggccaaggcaagaagatcacttgagcccaggagttcaagaccagcctgggaaacatggcaaaaccccttctctacaaaacatacaaaaattagctaagtgcggtggtgcatgcctgtagccctacatacttggggggctgagttgggaggattgcttgagcctgggaggtcaaggctgcggtgagttgtgtttgggtcactgtactccagcctgggcaacagagcaagacccagtctcaaaaagaaaaagaaaaaaaaaaaagaaggaaggaaagaaagaaaggaaaggaagcaagcaagcagggaaatgagactaatatattccagaagtgtattatgcaatgtttaaaataaggtgttgaagcatttccgtctctgccatcaagaaaccctagtcacccagaaagccttatttactaagggccctgaatggctgacatctgcctaggctgagggtacttcaaaaggcctagcaggggttcaagcactggctccacctcggaaaccaggcccaagaaatcgctgagtaaacccaagaaaaagtatatgttatcacccaccagagcaagttctgacaagacatcctgtggcagggatttggaaacagcagttattggctcctgtggggactcttactgacttgaccataaatagcttctcagataaaatcgggctaaaggccaggcgcggtggctcacacctgtaatcccatcactttgggaggccaaggcaggtggatcacaaggtcaggagtttgagaccagcctgaccaacatggtgaaaccgcatctctactaaaaatacaaaaattagccaggcgtggtggcacacgcctgtaatcccagttactcagaaagctgaggcaggaggatcgtttcaacctgggaggcggaggttgcagtgagccgagattgcgccattgcactccagcctaggcaacaaagcaagactccttctcaaaataaataaataaataaataaataataaaatcgggctaaagtatatgccagtgcaagatgtaaccaacaaagggaatacaggagtaggggtcaggaggaagaggcaaaggacagacagaaaaacagccagttaagtggtcacctgctcacagtggctatacctggacaggggccctgcagctctggccagctgacatgagaagggtccagctctggcctgggccctcaagcacccccataggacttgggagtcttcaggtgtaaagagaagtggcttcatgggggttccctaagactcagaccagccctacaatgccccacaatgcgaaacaaaacctggaccacaaaggtcccaggctctccagcacaggcctcagctttgatggctgctgggtgtgggtacccttctctttgcttacctatatgtcctaattttccttaaatatctttattgaatgtatcaaattataaaatgtgttcactgtaatacatttaaacaatagaagagtacataaaaagtcaacattgaaatcttccccctaccagcctctataaatccctctccccagaggttgtcactcatgacaacttggcgcctatgcttccaaaaacatgcatatatgtccatctggtagtctaccaagatgagggattacatgtaacgctttgcaacttttcacctaacaacatatttctaaatcagcccttatggaacttcatgcttttgagcactctctcgtagtattccattgtaagaatagaccatggtttacttaaccagaccataaccaaatcaccggatattccattggttctaatagtttgctgctaccaacaaggctggcataaacacctctgtacatgctatcccatgttaatctacgggacacaatcttataagttgggttgcagggtcgcacggtatatacatgcagtgttttgacaaaggggtgacaatgtataccccttggagagtctacaccaagtcatccttctaccaactttttggaattaaaaaattatatttagtcaaaaagaaaacaagaaaacaaaaaaccaccatgccccagcatcatgcaggaagagacacggcaggaatctggagggagagcccagctgtccctctctctgctccgcttgccaaactgggctccatgccaggtgtcctcgttaggccacacttgtgtccacttggcccacagttaaggctgctctctagcctcctggcaggacttgtgggcagagctaggcttccaaggcaggcttgcccggctatgagccaacagatggcctggcgcgggcctaactgccaccagccagtgtactggtgacttccaggttaatatctttagtgttactatctcacacagccaactgcctgccggactccctcagacatctgagatagaatacttcccctcccaccccccaatctgcacccctaactttcctatcccttctctggtagcccgtatctcaaaaggagctccagcatccacccagtcatttattaagccagcagcctgacttctaaccctcttcacccacatctaataaaaactggaccaatcttgtgggtttcatctcccaagctgatctctgacctggtccttcatcccccctcattccactccagccctggttagtccatattctcctacctagagagctgcaagagcagctagcaagtgtcctgcttctggcctgctcccacaaatccatcctctagagcctcagagcaagtttcttttttgtttataattgacgtgtaacaattgcacatatttataggatacatgtgatattttgatacatatatacactgtgtaatgaatgatcaattcagggtaattagcatatccatcaactcaaacatttattatttctttgtttttgagacagagtctggttctgttgcccagactggagtacagtgggggtgaccctggctcactgcaacctctgcctcctgggttcaagcaattctcctgcctcaccctcccaagtagctggggattacaggcatgcgccaccacgcccggctaatttttgtattcttagtagatatgggggtttcaccatgttgcccagggtggtcttgaactcctgacctcaagcgatctacctgcctcagcctcctaaagggctgggattacaggcatgagccaccacacgtggcctattatttctttgtgttgagaacattcaaaatcctctcttacagcagtttgaaaatatataatgaattattgttaaatacagtcaccctatggtatagaatagaacttctcctatctagctgtaattttatacagattaatcatcccctccctcagagcaagtttcttttttaaaaaaaattattattaattttttttttgagacggggtctctctctgttgcccaggctggagtgtagtggtgtgatcacggctcactacagcctcaacctcccaggcccaagcgaccttcccacctcagcctcccatattattatttttttagagattgggccggggggtggttctcactatgttgcccaggctggcctcaaactcctgggctcaagtgatgctcccacctcagcctcctcagtggctgagattacaggcgttagccaccacaccaggcccagtgagtttctaattgtatcataccaccaaccctacctcctccacaattccccttttcttcacccagtgaggggttaggttcccacactggctcatgacagcgagatgccaaacctcccccctgcctagccctagcctccattcctgctctggggcctcattctcgcaggcagcagcagcagcaagctggaggggagcaacaggtgcagcaggctgccagacaccaccaacaacctgtgccagttcatccgccactgagcactggggtccccttgtgcagcaatgccactgcccagggcagtggggccaacaagagggaaaaacttcaggcttgtgtggggtccaggctctcacaactcaacatgctcattccctttcttccacagagtaaatgttccttctattattgccttctgcacacccttctcccaatgccctcccccagcccccagctcctctctcttgcttgtagtcactagattgccagtaccatgtcatctcttcctttggatcacgtttgactcagaggaatttaggactgagctaagctcatcttgctgtccaagttgtggtcatctaatttcaccaattcaatagagtttcctttgacaaacaaaatgaaatgtataaaatatttccaggcggctgggcgcggtggctcatgcctgtaatcccagcactttgggatgccaagacgggaggatcacgaggtcaggagatcgagaccatcctggctaacacggtgaaaccccgtttctactaaacaaaatacaaaaaatttgccgggcgtggtggcgggtgcctgtagtgccagctactcgggaggctgaggcaggagaatggcgtgaacccaggaggcggagcttgcaatgagccaagatcgcgccactgcactccagcctgggcaacagagcaagactgtctcaaaaaaatatatatatatttccaggcaagagcatacacagaaaatcctaaacaagacatttcctacacattaaccttaatctaagaatctctctctttttaaaacaattttttaccataactttcatccttcctgagcaatatgtccttctaagacacccacagccttccaggaaccagcccaatgcatctatccagacctcgctgctgcaaatcctcgacacacactctactttctccttccacctcccaaggctgctgtcatgcacgaggcagtttcgtgtttctgagactactaatgccattccttctccctatgctcttcccacctcttggcctggctaatttggggctggggggggtggcgcagcaacagctttactgagatataattcatttgccatacaatttgccaacttaaagtgtacaattcatggttttaagcatactcacagaattgtgcaaccgccccacaatcagttttaggacttttttttttttagatggagtcttactctgtcacccaggctgcagtgcagtggtgcaatctcagctcattgcaacctccaccttccgggttcaagcgattttcctgcctcagcctcccaggtagctgaggttacaggtgcccgccactacgcccaactaattttttgtggttttgtttgtttgtttgagacagagtctcgctcagtcgcccaggctggagtgcagtggtgcaatctcggctcactgcaagctccacttcccaggctcatgccattctcctgcctcagcctcccaagtagctgggactataggcgcccaccaccatgcctggctaattttttgtatttttagtagagacggggtttcaccgcattagccaggatggtcttgatctcctgacctcgtgatctgcccacctcggcctcccaaagtgctgggattacaggcatgagccactgcacccagccaattttttgtatttttagtagagatgggggtctcaccatgttggccaggctggtatcgaactgaccttgtgatccccccgactcggccttctaaagtgctgggactacaagcatgagccaccgtttctggccagttttaggacgtttttatcaccccaaaaataaagcccatacccattaaccgtcacccaccacataacatcccctccctaaagtaccctgcacttactgtgcactcaatgctgttttgatggtcactcagtctgcctgttagacaggcacacttgccctaagcaagacctgtgtgacatacttgtattagccactcaaggcccaccatggcacctgtctcctaggagtgacagcagggaatgaccacagtggagcacctggcctctccaactgttcacttggtcccaggccctgtgcttacacttcacaaacatctcagagaccctaatattattcccattttacagctgaggataaatgacttgtccaaggtcacaaaaccagttaagtggctgcgctgggatcagtccatcagtaaggtcttctctaactgtctagacattgtctctgcccatccactgcggtcaccttctagcctcaccttcttctgttctcattaaggtctcctatgacctctgaatggcaaaaccaaatggaaggctgactttatcaatctcttggccacatttggcactcactacctcatttattttcaggctctcctttggagctacccacatttcagggaatgcctttggcctttttggcaggaccatcattttcccccaagtcctgtgatcaactgaagtgcttcctgggggagggtcccatcttcagcctctagtcttctgattccatggttatctcttggggaccgtggacacaccgctatctcaatttcccaagctcagaactgtcacacctgagcaccaaaaatagccttcatatctccactcagatggctcacagatccctcaatttcatcttctcacttctacaacgtgttccttctcctacatgccaccatcatttcattttgccacctacacagttgcctaagccaagatgaggacatcgaccttgacttattcttcccccagccttcttgcccaacgctcaagtcctatcaaatccccttcctaaaattctcctacaatactcccagccaatgcttgaggtcaagctgccttcaccgccagcctggattactataagaacctgcaaactgttctttctgcctccagggtggcctccaccttcaaattgcaggtatcctgttaaagtacaagtctaatagttttactatcccatccgctgcactcaggacagagtcctttctatggtttttacgatccttctagagctaatctctccttaactttccagccacagtcctaaccaccccacagtctgtgctaaacgacctgccacaccatcaacatttgcatctgcagtttcatgtgacattgcgactggcgattggccaagtccagcctggagtctctcttcttcctgcataaaattgtctcttgtgaaataatgttgaaaggcacaaagagatgtaatggacagaagacaaatcaatcagggtagagagggataaaagtgttctggacaacagccagcacatcaaacatgggcccttcacccatggcctccaacgatctaactctctggctgagaagaacaatttccaggaccactagctcacatggaagctgagaaggtcacaggactcctcttgagtgttaattatatttctttgcaacaggaggaagatgtcctgactggcccaagtatcaggtagagctcctattccaaattaggaaactggcattctggtactcatcagctgaagtggtgctacataatccagcaagctgtttgcttctctgtattttccaagtttctgagtaagagaagagctaaactagccatggaaaaaaccaagactgatgtccaatacagtatcaatgagaaccccatatgactcagattatggtctctaaatacaattttgtaatacaaagaaccaagtctcctaagagaaatgaagactctaggtctgggtcaagaaatcttcaaggtaagattagaacatatgggcatcccaggccagatggagtggctcacacctgtaatcccagcactttgggaggccgaggtgggtggatcacctgaggtcaggagttcaagaccagcctggctaacatggtgtaaccccatctctactaaaaattagccaggcgtggtagcgtaggcctgtagtcacagctactcaggaggctgaggcaggaaaatcacttgaacctgggaggcagaggttgcagtgagctgagaacgtgccactgcactccagcctgggcaagaaaacaagattccattccaaaaaaaaaaaaaaccagacatctcagatagtaaggaagctttcaatggctacagggttatataaaaaagacttggcagtcaactgaaaaagcttccactggccaagagacaatttaagcatcaataagattaatcaactgaaacataacaaatacattaaaaaccattagtgtgttataatactaaacaaatcttggttggtttagtcacaaaacctcattagtcatttttggaggatgtcagtgaaacaactctttattttgaaacctggtaactattggaaagaaataagcatttatcttaacctctcctatacagactgtatctcaggataactaagtacttgattactggaagtttacaggcatagaagtagtcaagctggcaactacagaaggaaacagaattagaatagcactattttgcaacccccgatgaaacgatggcttcagtcaataaatgtcaattattccttacatcctaaaaagagaaactaggtattatgtgcctcccaatagaggtacaaacattggctgggtgtagtggctcacacctgtaatcctgacactttgggaggctgaggtgggtggatcacctgaggtcaggagttccagaccagcctgggcaacatggtgaaaccccatctctactaaaagtaccaaaaaattagccaggtggcgggtgcctgtaatcccatctacttgggagactgaggcaggagaattacttgaacctgggaggcagaggttgcagtgagccgagatgtccagcctgggtgacagagtgagactctgtctcaaattaaaaaaaaaaaaaaaaaaaagaagtacaaacatcacctattaagtatttacaaaaaaaaaaaaaaaagaattgaaccaaaatctgagcaagcctctagatctactactaatttaaagtgggaacaagggacagaggaacaagttcaactatatgtcagagatgggatcagtaaaattgagatggatggaaaatctattaatcaagtgatctaacttcaatctatatattaaaatacttgagagagtatcaactgaaatgtatggatcatatttgcatcccaattgaaacaaataaatcatattttaaaaatttgagacaatcaggggaatttgaatactaaatggatatctgattacattaacaaattactgtttttaaggaaggaggaataatattgtcatttttttaaaatactcatgacttttttcagagatgctgaaatatttacaactgaaagggtatgctgtctgggacttacttctgaataatttgggagtgggggtataaatggaactagtattgaaacaagacagataattattttatcaataagaatttatgattgttgtagttagatgattattacttaggggctcattatattattgcttcttatttgtatatgtttgacagtatccataataaacagttttttttttttctttatacggagtcttgctctatagcccaggctggagcacagtggctcgatctcggctcactgcaagctccgcctcccgggttcacgccattctcctacctcagcctccggagtagctgggactacaggcacccgccaccacacaaggctaatttttttgtatttttagtagagacggggtttcaccgagccaggatggtctcgatctcctgacctcatgatccacccgtctcagcctcccaaagtgctgggattacaggcatgagccactgcgccctgtcaataaacagttttaaagagaaaagaggaaagcgaaattctggagggtacaggtacaaacaatactgaaaacaagggctaacatttacctagcgcttattctgtccttggtgctgggctaagtgttttacatgttgtagcttgttgacatttcacaacctgtatgagataggtgctgttaatacaccagttgaaaaacccaaggcccggaggtgttaaataggttatctaaagtagtccagtaattggcaggattggaat

SEQ ID NO: 8 - DNA, 153116 bp, Homo sapiens
ctggttaaatttatcaggagctcctgaatatttggtcattagtgcatgttatgaaagagagtctcaagcttttagcccacttgcaaatttcttgagtaattgtagtatttatatgattgaagtgcataagacatacttttaggttttggcactgagtggtataataaaagaattcattagctggtgcgatgatcgtgtcatcctttgcctgggttaccttttgcaaagggaaggtggtatacctgacgatagaatttcctggaggtaaaggatgcaagtataaaagataagttacaaagtacttgtactctcactgtttgcttttttgttttgagacggagtctcgctctgttacccaggctggaagcacagcagcatgatcttggctcgctgcaaccttcgcctcctgggttaaagcgattctcctgcctcagcctcctgagtagctgggattacaggcacacaccaccacgcccggctaatttttttgtatttttagtagagacggggtttcaccatcttggccaggcttgttttgaactcctgaccttaagtaatcctcccacctcggccttccaaagtgctgggattacaggtgtgagccaccgcgtctggtcttgtttcgttttttttttttaagagagaggtcttgctgtgtggcctaggctggggtgcagtggctgttcacaggcacaatcatgaggcactacagcctcaaacttctgggctcaagcgatcctcttgcctcagcctcccaatagctgggactacaggctcggcgtcaccatacgcagccccatgtgttgtattatcatcactatctttgaaagctgaatttttttggaaatttggtgaatcatagctagtagggtgttttctgtcatctcagactttgctgaatggaattatgaattcaacccataggatatctgaaatgctgtaatattatagtagtagtacaggtggttagtgtttgtcatgaatttatttccaggatgaattagacattctagaccttccccgcttccaaataatctgatcctcacctgagcccgggaggtcgaggctgcagttagccatgatcgtaccactgcactccagcctgggtgacagagtgagacccggtctccaaaaataaaacaagtatctgattcgacacattttacaagttttaaatttctgagaagtattaaaggttaaagaaggtagattgaatgctgtgtgaggtttgcacttaagacggctcatgtcttattttgttaaataatgtaactattggtatttggagaggaatttcacgtttcctagttttctctctttctagtttccctcctttaattcagtgttaacccacatttaattacaggatccttagctcctagagggtagagacctcattaattttgtataaacccctctggatacagctatttttcacaataccttttatatcagaggtacttgattatttgaatttagaggctgcttaatttaatgcctgaaatttatctcatgacttatgaacaggctgggtttcttcctatttggctgtggaaaaaggcattattttgcctgttttgacagcagccataaatggcaaggatatccatagttctcaaaactattcccaacctttctcctgccccagttgtcctcttcttatttggaacatcttcttgatgtatcagtgaggttaatgaagaattcattttgctgttgcccaggctggagtgcagtggcatgatcttggctcagtgcaacctccgtcccccatgttcaagtgattgtcttgacccagcctcctgagtagctggaattacaggcgtataccaccatgcccagctaatttttgtatttttagtagagacggagtttcaccatgtttgccaggctggtctcaaactcctgacctcaggtgatccaccgacctcggcctcccaaagtgctgggattacaggcgtgagccaccactcccagcctcattttgcatttagatgtgaaataatttaagggctgtgttgatcatctctctttaactataaaactcaatcagcctccttattttatgccaattgagtttttaactgtaaaacccaatcagcattaaataaaagtgaacacaggtcgaagaatctgtagtagaatctgatttattcttttttgagactggatcttactctgtcactctggctggagtgcagtggtgccatctccgttcactgcaacctccacctcctgcttcagcctcctgacttgctgggattacaggcgcctgccaccacgcctggctggtttttgtatttttagtagagatgggtttcaccatgttggccaggctggtctccaactgctggcctcaagtgatgtgcctgcctcagtgagccactgcacccagccttgatttattcttatcaattcttttttttttttttttgagacggagtcttgctctgtcgcccaggctggagtgcagtggcacgatctcggctcactgcaagctccgcctcctgggttcacgccattctcccgcttcagcctcccgagtaactgggactacagtcgcctgccaccacacccggctaatttgtttttgtatttttagtagagacagagtttcaccgttgttttttttttttttttttttgagacggcgtcttgcactgtcggctaggctggagtgcaatggcacgatcttggctctcggctcactgcaacctctgcctcctgggttcacacgattctcctgcctcagcctcccgagtagctaggattacaggcgcacaccaccacacccggctaattttttgtatttttagtagaggtggggtttcactatattggccagactggtgttaaacttctgacttcgtgatctgcctgtgttggcctcccaaagtgctgggattacaggcttgagccactgcacccggcctattcttaccaattcttatgtagttaagaatgttggagacgtcttcaacactaataatcaaataaagaaaaaatatttataagaagtatggttactctgtggtgagaagagtaaaaactaatacatatttctaattctaaagattgaatggtaaaaagtatgttggattggcacaaggtgtgctattttataatttgtgaaacctacaaagcataagacaacctggaaatcttaaatataggcgtcatactagtgtagcattttaatgttttcattttgtttattttcgtctttattttcctatgacgatgttgacaccatattaatattttggaacagactttttccaactcttacctatatgtaggtatttcattaaaagaattccatggtcacataagtttggaaaatgttattctagaatgatctgtgtttaccacttctgtctcagagagggatctttatgagataatggacatatagtgatgaagcaggaaatctcttctgaggttggcatcaagacaggagatgaggtaatacgatctgcagagtgtcttagcacagaactgatttggggtacactggaggtggaaggatttgctactacgtgaatactgaagaaacaagccacagggattttgacacggggcagtcgttcatgggctgtgtcttttctgccaccactctgctctgagaatttcattatctgaagctgaaaaagttggctttcttgttgagcttaaagttatttatcatattattcagcagacactttcatagcatttacttggtactgttttaagcactttacaaataattgatttgtgagaaaactgaattatgcttcaggtcgtacagcctgggcagtttccctcccagaaactttttttttttttaactagtgttggggggttttttgttaagatttatgctcgtagtacatgggaagttttttttgttttttgtttttgtgatggagtctcgccttgttgtccaggctggagcacagtggtgcaatctcggctgactgcatgcaacctctgcctcccaggttcaagtgattctcctgcctcatcctcccaagtagctgggattacaggcgtctgccaccatgcccagctaattttttgtatttttagtagagacagggtttcaccatgttggccaggctggtcttgtactcctgacctcagatggtctacctgccttgcctcccaaagggctgggattacgagtgtgaaccactgctcctggcctgaaagattttttaaaatgatgttgtaatattgatgttagttcagtttctatggatataaaacatttaccacatgaaaatggtaccccagttgattagggaaatgccatcagagaggtttagagatttagcatttaggttgacaagtgtaccgacagtgccagtaatagaaataggaagtataatttttacctctaaagaatctaagctgttaaccatcaggggaactattggatagctaacttggttgatggctttaaacaaattgccccaaatgtgaacctcttgatttgagatgaagactctatgcatggaaaccaattatgcttcagaacttaattagtagaataaaccaaacaaaaaactttttctggtttcagcaaagaagagtttacatttagatgatgaaaaatgtattttttcaaaaatgcttttacttctttttttcttaatttcctttgggaaaggggtaatgtctttgttttttgcctgagggaaatatagaggtaacttgctcaaggcctacataaaatgacactttattgaagtggttttagattgttgcatctgttgagctctaacatccaaatcttttatatttataaatctaatctataaatatttattagatgaatacttttctctttgttgtagtcagaccaagttctcctaaagtcaaatgtgagaaaagacatatttttaaaaatcatctagggttttagagagtactgtcacatcccatgccaatgtatggtttatcagaggagagacaattccaagtgcattttttatgtactgcctgctatgcagtgtttcagcaagggaaatcaaggaaaattaaagtgtctcatttatacaattttaaattgtggtattctttaaaattcaaaatctttagattttgagtgatttttacatttaaaaatagaagtttttaaatgcagagatggatagtggcttctggttagacattagcagtgtgagatcctaacgtcagcaaaaaatgacctgaaagaaagtattgattccatgtctgattttatacttaagcagccaatggcaaatgtcctcaaaatggaatcagatgtttgtaacttaatacttaagaaaaatgatgagtgcatgtttttttttacttttaagtattctctgtgctgcctggcttaagacataaactgatgtaaaaataaatgactgcttgcataatttatgtaatgtcctgctcctgatcctgtttgtattgatttttctaaaaggcttttgtggccacaggaaccaatctgtctctccagttttttccggccagctggcagggagaacagcgacaaacacctagccgagagtatgtcgacttagaaagagaagcaggcaaggtaggaaacatttctttgcaatttaaaatactgtgggttgttttgttagagattatctggtaatttacattttaataaagatcacagatctgattataccagcatatgctcagatttgttttcattccatgttataaggatgtaatataattttttttttttaatggcgtttcgctcttgttgcccaggctggagtgcagtggcgtgatgttggttcactgcaatctccgccttccagtttcaagcgattctcctgcctcagcctcctgagtagctgggattacaggtacccgccaccacatctgactaatttttgtatttttagtggagatggggtttcaccatgttggccaggctggtctcgaactcctgaccttgtgatccgcccacctctgcctcccaaagtgttgggattacaggcgtgagccactgtgcccggccaatataattttttaaaaccactgttaaacttttgtatcactccattcctaatttcatgtacataatatttgtcatagaacattctaacccttaaggaaagtaacataacaatttctttaaaagtttgaggagatatattttgtttacaaaaatatatgtaagtatagtgctataaaaataaaacaagaggaaaacggaaaaaagctctctaggtttaaaaattaatagtatttagaaatagctcataggtaactttctaattccattaacagcaaatttacatttgagaaaaacaatgtgaaaactttaacttggaaatactttttttttgttttgagaaaaagtttctgggaacatgtcttacagtttcgatgttagaagtttaggttaaagatacaaaaatataggtaaaatgtttaagctgagagccttatttcaggtctacgttaaatgtattatgattttggtaatttttttttttttttttttgagatggagtctccctctgttgcccaggctggagtgcagtggtgtgatcttggctcacagcaacctccacctcctgggttttaagctattctcctgcctcagcctcctgagtagctgggattacaggtgtgcgccaccacgcctggctaatttttttgtatttttagtagagacagggtttccccatattggtcaggctggtcttgaactcctgaccatgtgatccacctgcctctgcctcccaaagtggtgggattataggagtgagctactgcacctggcctggtaaattttaatgaatagcatcttggattggttgattcttgattgagaagtcaaggagttgacttctagaataaaatttttaaagaagaaaccctcttttaaatatagttttatactcaaaacacccttttggatccagtttcatactttttttgtgtgtgtttgttttgcagtgtgtttttgtacccgtttctatcaacttactaaattaattttctaagtgtcatcatgaatagcataacctgccacatttatgtaaaatgtgagaaatgtctaaatattcctttgagaaatatttaatttaatcttgtgtgtatatatatatatacacgtatatatgtgtatatatacgtatatgtgtgtgtatatatgtatatatgtgtgtgtatatacgtatatgtgtgtatgtatatacatatatatgtatatataaaatgaattttttgttttctccaattctgtagaattagatttgatcttttgtgcgtgacaaaacaatctttggattagaaaagggaaaacagattataagatttaaaaaaatgagtactaagcaagcagtttgctttcctgtgtattagcttgtttgcttggaaaattaaaagtgaatgttccagattttactatttggtaattcttacacaatatataaggaagaatttgagaagtccttgtacgattattggtttttttgtgcttctggtgcgtgtatgtgtgactaaatgaagaaattattttttttcttgtttgaatacttccttaaagtttgtttaacatggtagctcagatactaaagacgtaaaccaaaaaaaaaaaaaatttgttttttgtcagctttagcccaaaactattttaagacttcaagggcaacatctcagtgttactgaagtcttccggtatttaataactagtaaatgggttgttaactctaccagaaattaagtttgcttgaattaatttaatgatactgcttcactagtgtgaagaccacataatccttggacttaaaccattgagatgtttttagttatatgaccaaaaataacaaaaatgtgagatggtttattctagtacagtcatgtgtcacttaatggtagggatatgttctgggaaatgtgttgctgggtgatttttatcattgtgtatatatagagtgtacttacacagatctagatggtatagcctactacacacttaggctatctggtatagtctgttgctcctaggctacaaacctgtactgtacagcatgttaccgtactgaatactgtagtcaactgtaacacaatttggtaagtatttgtgtatcttgatgtatctaaacatagaaaagatatggtaaaaatacagtatttaaaaaatggtatacctgtatagggcacttactttgaatggagcttgcaggactggaagttgctctgggtcagtcagttgagtaagtggtgaatgaatgtgattctgtagattatataaacatagtatgcttaggccgcactaaatctataaaaattaagcaattgcactgcaatgttaaaatggctatgatgtcactaggcaataggaatttttcagattcattataatcttacaagaccactgtcatatatgtgatccattttaggctgtaacgttgttaaagcaatacatgaatgtattaaaaagatatgtttttaattctattaggaagagtgatagaactatgcaggctatcaggaaatgtacattttattaatactggttttagaagtttttttttctgtgaagggacaaatgtaaatgttttcagttttgcaggctttcagtctctgtcacaactactcatctctgtaactctgctgttgtggtgtgaaagggaccctagacaatatgtaaacaattgagtgtggctgtgttccataaatggtgacactggtagaaatcagtatctttccctcagatgtaaatctgtaaatgtttatgcataggtcatgtatttctcagatagaattttgtcaacatctgtactacttctgtactactttttttctagaagaaaaaaaagcattttaaggcaaaaactcgtactgtactgttccgtgccactgtaataaagttctccagtgaatttagagaaaaggcattgccctgtgttttctcatccgtggagctcagactgtggggtctcgaatttcttttctctttttatggtctgttttattataaccattaggttttgtttctgtccccacaggactaggactggaagcaaagaaaattgaaggaacttctccaaatgttaattatttgcctctgttccttatattggattccaaatcagtgtcttcttccatattctctcaactgagttaccttctgaagcagcttagttctcgtcctgttcatacgcagttttgaggaactatagttgtaaaggctttagagttaggcaaaattgagttaagttctggcttctgcatttactacagtgtaactttgggcatgttgtttaatcattgtaatccttagttgtagaatgagattaatgggtacttcccagggttgctgttgagagtaactgaaatagtgtatgtaaagtgttttgaccactactgtacctgtcacagttatcaaaaaatttattcattcagaaggtctttgttgaacacctgttacgtgtactgagcattgtcctaggtatttgagatacatcagtgaacagagatccttaacagacaatatacataataagttatgtaatagcttacaaagtgacagtacctttgggaaaaaggaaaggtattataggataaagatgatcaatgaacaggaagtttgcagttttaaattgagtggtctgggtaaggaagatcatacctgaaccaagacacaaaggaggttagggaatgatgagccctgcaggggttgggggtggaggagagatgttccggacaaaggaaacagccattataaagggccccagagtggcaccctgtttttgatcaacagcaagcaggccattgtggctggagtagactgtgaaagaagttgtagtagatgaaatcagaaataacaatgagccagttcatgtgaccatggtaggccattgtaaccacatgggctttttattctgagtgagatggggaatagttttgagtgtttagtttgcttatattttagggacagggtcttggtatgttgcccagggtgactcaaactcctggactcaagttatgctcttggtcagcttccgaagtagctgggagtaaaggcatgctcctgcacctagctcaggcttttgagcagatgaatgatattatctacgttaggttttgacagactcatgctagctgctaggttaataataggttatagggggcaaaagtgaagcaggctattgcagtaatcttggtgagagaccagggtggtagcagtagaggtagtgagaaatggtcatatcctggatgtattttgagatagagccaataggatttgcttatggattagatatggcgtgtgagaaagagaagaataaagaatgactctaacttaggctgaggcaggagaattgcttgaacccgggaaggggaggttgcagtgagctgagatcgtgccactgcactccagcctgggcaacaagagtgaaactccatctcaaaaaaaaaagaatgactccaactttttggctagagaaactgggactatggggttactgtcatcgggatgggaaaactggctggaacaattttgaacagcaggttaggttggtttagcgcatgtgaggttgtggtgggagcttgttattgcagcttgtttctttacttttttttttttttttttttttaagagagagggtctcactctgtcacccaggctggagtgcagtggtgcaatcatagttcactgtaacctcaaacctcaaactcctaggctcaagagatcctcctgcccttctttttttttttttttttacccctgacaaaacaaggtcttattctgttgccaggctggagtacagtggcgccgtcatggctcactgcagcctcaatgtcccaagctcaggtgatcttcccacctcagcctcctgtgtagctgggaccacagcatctcacctgtaaccccagcaccaccatgcctgaagttatttttgtattttttgtggagatggggttctgttatattgcctaggttggtctcgacctcctgacctcaagtgatcctcctgccttggcctcccaaagtgctgggattacaggcatgagccaccacgcccaggctttttaaaaaatcatttgtttctaagtgtttcattattttttctgcctctgtctcttgactgactaggacgacagatatttgccaccacatctggctaattttaaatttttttgaagagaaaaaaattttgctcaggctggcctctaactcctggccttaagcaatcctcccaccttggcctcccaaagtactggaattacaggcatgggacactgcatccagcctgagttttaacaaatgtatgcacccatgtagatgctaccacagtcaagatatatttcagtcacccccccaaaggtttccttgtgcccctttgcaggaacctgggactgactgcactgggtggttctgcctcagtgtctctcatgaggttgcagtcaagcttttgcctgggactgtgcagtctctgaagacttgactagaactgaaggatctgcctgttggtaggtggcttcacttcctagtcatgcttctccatagagagaaaaagagtgaagccaccatgccttttatttatttatttatttatttgagacggggtcttgctctgtcatccaggctggagtgcagtggcgtaatctcagctctacaacctctgcctgccgggttcaagcaattctccttcctcagcctctcaagtagctgggattacaggcacatgccaccacatgtggctaatttttgtacttttagtagagacagggtttcaccatgttggccaggctggtctcaaactcctaacatcaggtgatctgcctgcctcagcctcccaaagtgctgggattacaggtgtgagccactgcgcctggtccaccatgccttttatgatccattcttcaagtcactttcataccttttatgatctattatttgagtcacttgttgcttagcctgttcattagaagctggtcactaagtctagcccacattcaacagggagggagggattacacaggggtgtgaataccaggaggctgggatcattgaggccatcttggaggccagctacaataatactcacttaaatttagcgaactcagaaaaaattagaatcctaatagagcggaaacaaaaagctctatattctctattatttgaaatacagttttatgatttaagaaaatgggctcatagaaattagtccttttattcattctgttgcttatgtggctatagaatattttcaaatcaagggcttctataaggaaggtctgttaacgggtgactgattataagtatataccttacatatgaccaagtcagagcacagaattttataatccttcaaatatatttgaaacttttatacccaggtacctggtgagctgtctacattggctcttaataaggatctttctcagaaatgatttaaactaataacagtataatagaaagagctctagatttgagtcaagacagtcataactattttccttaacatgtaaatgaggatcagaatgtctgccctattcatgtgcctcatgtgagaattaaatgtagtaccagaatatgtgaaaatgccttttaaattgtaaacccctgtctacagttaggcaatttgatggttctgtagggtgagattatagctaactgattgatagagtgtttgtgctacagtgtgccttaggtaagcttcacgtcaggtagttgaacaatgttggaacactacatctttcccaagtgttccatcctggtgtgttacaaacactggcagccaaaatgttcttaattctttaatctagctgtcaaaagacaagggaaaagcaactaatcagaatttaaatcattcttaagttaaaattgtgtagaccaggcaactccagttcctttgatctttcctcttaggacttatttccaattacttttatttcaaataaatgcaagtgattatggttgaccataaattattagtcttgagtggtcagattaatggtttttacatgtattctgtgtctcataaagcttcattgggattttgaaataatgattggatgtacttactttgcgatcccagtttatgactttaaagataaggggtatgaaaatcatttcataaaaggaaaaaaatgaactttacagtgctactgttcatttttttctgtggaaattgaatatgctatctcgtttttaccacattgacctcagaaaaagagaggttaaacttttctatggttgttacattcttgtttatagcttatgattttaattgatagtcaaatacattaatgtcagacatcgagaagtatttattaagtatatgtcattagagtagctacttttaaaaattttgataagttgtattttttttctttctggactttatacttaaaagtcttttaatttatttttatgagcataaaataaagcaaaatctaacaagattggatttaatgagtgaggacagaattttattttaaatggccttttctaataaaggtctatgattctgcttcttctggtaccatttacgcacttgcctgcaggatctttgtcccaaaatacatattgtgtttgtttatataccatccacaatttggcagagtttacaggacttcttgatgttagctttgagaaatccctatttaagctcaagaagttccttctctgtagatagcccagtcattccaaataaaagatctctatggtaaagctttggagtgtgattttcttcaagagaaattagacaactttacaaataccttgtcacatctggattttaagtatttcagttcgactaaaatatgaattgacagcacttagttattgacagtttagtgtattgaaatctggtttttaaaaatatgctttagataaactataatactctaataataacggaatcataaaatttagaactggtaactgcaagcttatatatatatatatatttgacacctttgtagctggcagagcgtttgtatttttaaagaaaagtttttattttagttattttagttatttttcaatctaagagaggaagtcgactttctgaaaaaattaaaatgttttggctaggtggggtggttcatgcctgtaatcccagcactttgggaggccgaggcaggtggatcacctgaggtcaggagttcgagaccagactggccaacgtgatgaaaccccacctctactaaaaatacaaaaaattagccaggtatgctggcatgtgcctgtaatcccagctacttgggagactgaggcaggagaattgcttgaacccgggaggcggaggttgcagtgggctgagattgtaccacaacactccagcctgggcaacagagcaagactctgtctgaaaaaaaaaaaattaaaatgttttaaaattagtatgtcatagtaccttccagttagagtacgtgaatctgcatacatggtaaatgcacctctgaagcacttgaagattgtgaagtcccgttttctcttcttttggattgcattatttccattttagtgtaaaggtgaaattctctttcatgacctttcctgaattacatattccaagtgagagaaggcagaaataatatgtctgagaagagcatccttcactcttcccctccttccttctactttctacatttttttttttttttttgagacagtgtcttgctctgtcatccaggctggagtgcagtgatgtaatcttggctcactgcaacctccgcctcccaggttcaagcgattctcctgcctcagcctcccaagtagctgggattacaggcacccgccaccacacctggctaatttttgtgtttttattggagatggggtttcaccattttggccaggctggtctcaaactcctgacctcaggtgatccgcctgtcttggcctcccaaagtgttgggattataggcgctctgagccactgtgcctggccttttttgttgttgtttgtttgtttttgaaactagatatctctctgtcacccaggctggagtgcagtggtgtgatcttggcttactgcaacctctgcctcctgggctcaagcgatcctcccacctcagcctcccaagtagctggaaccacaggcacgcgccaccatgcccaggtaatttttttgtagatatgggggtctcaccatgttgcccaggctggtctcaaactcctggactcaagcaatcctctcgccttggcctctcaaagtgctgggattacaggcatgtacccatcatttttttttaatggttaattcaaatgctgccaggataaagactattgaaatgttgttgtctgaagatgttaatttctttgtagcactgctatgccctagttttactatttcccattttcacttgtagtttttcaatcagcattattgaggtataatttacatgtagtacagttcacctattttaagtgtacaagtctgtgacaactgtgtattcagtagtataaccaccaccaaagttcaccattgcttcaaaaagttccctcatgcccccttgcaggtagtgttctaattgatgcagacatacatgcactgatacttttgtgatcctcatcttacagggaagaaaacgtttgtaatttctttttaacagcataaaaatgctgtttaccttcaggtgcagagactttgtttcttcaatattattctttgatgcttagttttgtacagaggattggaagctacagacaagctaaagtataatagtgatatggtagactttaattattgttcctttttttatgaaagtatgcacgtgaacagttggaaagtattatctgttataagcttttcagtttaagctgggcctcctcaaattgatgtgtgtttaggaactaagaattttaaataacatttgaagggccgggcgcagtagctcatacctgtaatcccagcactttaggaggccaaggcaggcagatcacaaggtcaggagttcaagaccagcttggccaacatagtgaaaccccgtctctactaaaaaaaaaaaaaaattagccaggcataagctgagatcatgccactgcactgtagcctgggcaacacagcaagactctgtctcaataaataaataccatttgaaatgtcttcaatgccatgtgtggaaactatttaaaaaaataaaacgtgcctcttggcagtattgctgtgctttcaggactctaatgcaggctgtacctaagagggaaagggctgagtctggggatggttggcaggttgtttttgtggatgaaaaaccttttacccatgtatgcagtcagtactgagcctttttgtgttttaaaacttcagatgtaaagacaggttaatcttcagattaaaacaaaaggatggcctagaaacttgtgacttcgacatttacattagaagaatgtagatgttttcaaataaacaaatctgcccatatcatagatgttcaaagtttgttccatataataacaatgatagtttctaataatcgtgtggccctgtttgcagaacagtgttctaagtaatgagccatttgggagaaccctttaaattttttttttaggatatttattcacaccagctttttagtcctgagtttctatccatccctttgctatccagaacatttcttggccatttttttactgggtcaggtgccgtggctcgtgcctttggtcccagtgctctggaaggccagggcgggtggatcgcctggggttaggagttcaagactagcgtggccagcatggtgaagccccgtctctactaggaatgcaaaaattggctgggcatggtggtgggtgcctctggtcccagctgctcgggaggctaaggcaggagaatcacttgaacctgggaggcagagggtgcagtgagccaagatcgcgccactgcactccagcctgggaacaaaattccatctcaaaaaaaataaaaataaaaatgcagaaattggtcaggcgtggtgtcgcatgcctctggttccagctacttgagagaggctggggtgggagagttgcttgggcctgggaggcaaaggttgcagtgagcagagatcgcaccacggcactccagcctgggtgacagagcaaggctccatctccaaacaaacaaataacaaaaaaaacccctaaaacattttttattttccttaaatgtattggccaaggttaaaatatccatcctgaatattctgtatgaaaacattggatatgaagaaaaaaagaaaattcaggcagttgaccaggggagagaattgagctttttggttcttcctgacacatattctcagtgagactatactcacttttttaaaagctatttataaaatattaaaataagatattacatgaagttaaaaattgaaacgaaagtcagcatcttaattcaccaattacacaactgaatggtgttttttgtttgtttgtttgagacagagtctcgctctgttgtcgaggctggagtgcagtggcatgatctcagctcactgcaagctctgcctcccgggttcatgccattctactgcctcagcctcccgagtagctgggactacaggagcccgccaccacgcctggctaatttttttgtatttttttagtagagacgggttttcaccatgttagccaggatggtctcgatctcttgaccttgtgagccaccgtgtctagccttttttttttttttcttttttttttttttgagatggagtttcactcttgttgtccagactggagtgcaatggcgccatctcagctcaccacgacctccacctcccgggttcatgcaattccctacctcagcctcccgagtagctgggattacaggcatgtgccaccatgcttggctaattttttgtatttttagtagagacagggtttctccatgttggtcaggctagttttgaactcctcatctcaggtgatctacccacctcggcctcataaagtgctgggattacaggtgtgagccaccgcgcctggccactgagtggtttttaatatattcacaaccatcaccattatgtaatttgtgagtatttcagaactctgaaccattttatttattttttatttatttacttattttgagacagagtctcttgtctgccaggctggagtgcagtggcgcaatctcggcacactgcaacctccgcctcccggattcaagctattctcctgcctcagcctcctgagtagctgggattacaggagcctgccaccacacccggctgatttttgtacttttagtagagacggtttcaccatgttggccaggctggtctcgaactcctgacctcaggtgatctgcccaccttggcctcccaaagtgctggtattataagcgtgagccaccgcgcccggccccattctgtttatttttgagacagactctgtctcccaagctggaatgcaatggcacaaccatggctcactgcagcttcaacctcccaggctcaagcgattcttccacctcactgggactgtaggcacatgccaccgcaccagctgtttttttttgttttactttttgtagagatggggtctcactatgttgcttagggtggtctcgaactcctggctgggttcaagtgatccttccactttggcctcccatgaaccattttaaatgctttttgagaactgcaaagcagtttttatggtgatcactaccaccggacactgtgctagatggtttacattatcactaattctcctaatactgcactgtatagaagaactgtttaattttagaacatatctggtgatagcttgattttacagctgaggaaactgaggccaggaggctaagttaaccttcaaaagtcgtattatctgtttcctggtacagccaggacccagacccacttattttttacccctaagtctgttctttgcatactacactactgctaataagtaatcattaggtaagttgatgcaaactccacataccaccttccaaagccttatttagagttattttggtccaccaagttactctactgatatatatatatcataaatatatcatatataaattatatgtgatatatataatatatgttatatatataatttatatatcacatatttatatgtaatatatatcacataaattatatataatatataaatatataatatataaattatatgtcaatatatatagcattatgttctaagacacacacatatatatgtatatataacgttctaagactttcagggattcctgtactgttgatagtaccaaatcctatatatgtgctgtttttttcctatacagatatacatatatacgtatgataaagtttagtttataaattaggcacagtaagagattaacaaccttaactaataataaagtagaacgtggccgggcaaggctgctcacagctataatctcaatgttttgggagaccaaggcaggaggattgcttgagtccaggagtttgagaccagcctgggcaatatgagaccctgtctgtacaaaaaagtttaaaaattagccgggtatggtggcatgcacctgtagtcctagctatttgggaggctgaggtgggagaattgcttgaacctaggagtttgagcctacagtgaactatgattgagccatgacactctagcctgggcaatagagcaaaaccctgtctccaaaaaactaaaagtttaaaaaaataaagtggaacactaataacaatatacagtaatcaatgtaaaattaaggttatttgaacataagcactgccatactgcagcaggatggccactaagtaactaatggacacattccttataaaacatggatgtgctggacaaagagatgattcacctctctggagagaaggagtgcaatttaaaacttatgaattgtttatttctggaatttttcatataatatttttggaccgtgattgactgtgagtaactgaaatcatggagagcaaaactgtggctaagcggggactactgtacttgatgcattttccttttaggaattcttttaagttatttttcatttgttagatgtgtcttacaaagaatagataaaaacatgtacattttaggaataataataaaaggaacataggtatagtaggactgatgttccgtatggtagctattatacaatccacatgtggctgttgaacacttataatgtcgctagtgtgaattcacatgtgatgtgtgaaaaaacacaaaccagattttgaaacctggtatgaaaaacaaaaataatgtaatgtatttatatggatccaaaatgtaatatatatatggatccaaatatatgtatatatatccaaaatatatatccaaaataatgtaatatattgctatatatatatatgtacacacacacatacatatatggatccagttttatactcattattttttctgggtttgtttcacagtgtgtttttgtatgtatttctatcaacttaactaaattagttttctaagtgtcatcatgaatagcataacctgccacgtttatgtaaaacgtgagaaatgtctaaatgaccaacatatataggtaaaatgtttaagctgagagccttatttcaagtctacgttaaatgtattatatgattttggtgttttttttgtgtttttttttttctgagttggagtctcgctctgttgcccaggctggagcgcagtggcgtgatcttggctcactgcaacctccaccttctgggttttaagctattctcctgcctcagcctcctgagtagctgggattacaggcatatatatatatgtgtatacacacacacacacacacacacacacacacacgcatacatatatatagcaataggaatatatatatatattttgagacaagttctggctctgtcacccaagctggagtgccgtgacacgatctcagctctctgcaacctctgtctcccaggctcaagccctcctcccatgttgcccaggctggtctcgaacttgtgagctcaagtgatccacctgcctcagcctcccgcagtgctgggattgcaggcgtgagccactgtgcctgacccaagatattgcttgcttgataccatgttgaaaattttagatgttttgagttaagtaacattattaaaattaatttcacctctttttactttttaaaaaatacctactaggccgagtgcagttactcatgcctgtaatcctagcactttgggaggccaaggtgggaagattgcatgaagccaggagtccgagaccagcctggtcaacatagtgagaccccatccttaaaaaataaaaacattttttaagtgactgggcatagtggggtgtgcctgtagtcctagctcctggagaggctgaagtgggaggtttgcttgagcccaggagttcaaggctgtagtgagctgtgatggtgccactgcaatccaacctgggtgaaggagggagaccctgtctcttaaaaaaaaaaaaatgcctgctagacaatttacagttacatatgtggcttgcatttgtgattcacattatatatttctgttgaacagtactgcctgcacagttggccaggtatggtggctcacacctataattgcagcactttcagaggttaaggagggaggattacttgagcccaggagttacagaccagcccgggcaacaaagtgagaccccatctctacaaaaaaataaaataattagccaggtgtcgtgatacaggcctgtagtcccagctacttgggaggctgaggcaggaggatcccttgagtcctggaaatcaaggttgcagtgagctgtgttcataccacagagcaagatgctatctcaaaatgagtcctggaaatcaaggctgcagtgagccgtgttcataccacagagcaagatgctatctcaaaaaaaaaaaaaagaaaaaaagagaaagaaaactttacagttcttttcctcaacccgtctccccccacaaaataatcactatcctgattgatgtatttgttcccttacttttctttgtcattttatttcctgtgcatatatctctaaataacgcattgtttagtttttaaaaaaaatgaaactaggaagcacacacttcagggcagtgtaaacaacggactctaatgtcactttctctctttttttttttttttttttttggtgagaggagtcttgctctgtcacccaggttggagtgcagtggtgcgatctcggctcactgcaagctccgcctcctgggttcacgccattctcctgcctcagcctcccgagtagctgggactacgggccccctcaccaccacacctggctaattttttgtatttttagtagagatggggtgtcactgtgttagccaggctggtctcgatctcctgaccttgtgatccacactcttcggcctcccaaagtgctgggattacaagcgtgagccaccgcacccagccttctaatgtcactttcagatgcagctcctagaagatgagctgaacagaatcttagggtcaagtccggattcagcttccctgtgaatttttagagcctccctggggaagcttgtgagcacagtcatgagtggattatgggaaacctagggctcacactggagttagggcatctggcacactgaaaccattgctcaccgtgtgccggagatgtggaggaatatggtcagagggagttagctgctctggtattttctgcttctaggctcaccatgacctaccttcttttatcctttttttttttttttaatttcttttgtcaaaattgatgtctcattccagagctaccttcttttcacaggagtgagtcaaagcacatcacctttgtcagctcaaatgagtgtccttagctggtcccagcagtggggaaggcttatatatgagcattttgccctcaggatcttggtgatgaccatcctcagaatgtccatctcttcaatctagactgattgtcctctatatccagcgcactgctttcatactgatttctgtgttcatcctctgctgtgaggggcttttttgtttttttctttttgtttctttttcagtttttctgtcttcctgtttcttggtttacggtctctttgtggataacagagttgttgcatatttgaagtgtctttattctacgatactttattgtaagtttgtcttgttctagagtttgaggttagagattattttcgttaagaaggccttgtttcattgtcttggtttaaatgttgcagttgaaaatctctgaagtcattgtgtttcctgatctgtttgtgaccaatttccccgtctttggaagtttgtaaaatctttgtctccatgttttggtatttatctatgatgtaacctagtgtcggtccacagtcattccttgtgcagggtacttgccagccctttacagtatggcagctgtgtccttcgtaaggaaattttcttatattaattgatgacttcctttcttatattttttctattcttttctggaacatctactatttggatgttagacccacaggaatgatcctgttaccttattttcttactgtctcttttgtctttttggtctaccttccagaagatttcctctactttatcttcagagtcttatattgggtcttaatttctactatatttcaacagagctttttgtttgtttgtttgttttgagacggagtctcgctctgtcgcccaggctggagtgcagtggtgcgatctcgcctcactgcaagctccgcctcccgggttcacgccattctcctgcctcagcctcccacgcgtagctgggactagaggtgcccaccaccacgcctggctaattttttgtatttttttttttttttttagtagagacagggtttcaccaagagctcttttttgtgtgtgctacaaatgttccttttttgttagtatcctcttcttgtttatcgggtacattttatctgagaatctagctggtagatttttactgctttacatcacttcagaggaaatggctgcaactgaagggtgaaagtcagaatttatcttggctcagcttttcatgtaagaaaagaaaaatacagtgaaaccaaattaaaataattatgtggagagcatattggtggcaagttaatacatttttatgactttttggagggtctaatttattcttaacagaagtctgagtttagtatccatttattgaatatgtatttatatgtgtatacgcacacacacacagtgtattaaatctattgaattccagacactttctttttttttttttttttttttttttttgagacggagtctcgctctgtcgcccaggctggagtgcagtggcgcatctcggctcactgcaagctccgcctcccgggttcacgccattctcctgcctcagcctactgagtaggtgcccgccaccacgcccagctgatttttttgtatttttttagtagagatggggtttcactgtgttagccatgatggtctcgatctcctgacctcgtgatccatctgcctcggcctcccaaagtgctgggattacaggtgtgagccaccacacccggcctccagacactttctttagtttttcattttatgatttctcttttggactgtaagatgatcggtaaattacattaaatcactatagaagaagctatttttacacatacatgcaacccagttatgattcagaggcaaacaagattgaatgactgtagagattatctgacagttgagcagctgactgtccatttatgaacagggaggtgcatgtggctaaaggaggatgagtcagaaccaagtatcttctaaaggaatctgttgaatagactacagaaatgattacagcaagcgacagggtacatacttcttcagtggaatatcttgttttcttgggtgcctatggccatcccagtattactgttggatgattcattggtctgtgggtaggaacaactcttcattgtcagggaaaaaacagcatgtctcctttggaaagaaattactgtcagtgttgctgtgatgttctctatgttttataagttttcattttgtgctttttgttggtgatttcactgtttaaaatggcccacaagcataatgttaaagtgcagtctagtattccttaaatgcaagaaggccgtaatgtgccttatggagaaaatgtacatgttagataagttcccttcagtcatgagttacagtgctgtcagctgtgagttcagtgttagtgaatcagcaatatatattgaagatgatgtctgaacagaagcatacataaaacaaaattatgtattgatcagttgaggaagatgttaggctagaaggaacctacgtctgcatttcccctaggaacagtggtttagtgttcactgatacagtgttcatgtagatttgatagagtataacaatggcaagtcgtgtgtgtgtgtatgtgtgtaggcttaatggttttctttacccagtatttactatgtttttttccattaacagcataatgtaaacatcccgtgtaacatgcttgtttttggtggtgagggatgcttgtttttggtggtcaaggatcagcagacctgcctggattctagcaggcttttttttttttttttaagacagagtctcgctctgtcaccaggttggagtgcagtggcatgatctcagctcactgcaacttcggcttcccgggttcaagcaggtctcctgcctcagcctcctgagtagctgggactacaggtgcgtgccaccacacccagctaatttttgtatttttagtagagacggggtttcaccatgttggccaggatggtcttgatctcttgacctcgtgatccacccttcttggcctcccaaagtgcagggattacaggcgtgagccaccatgcccggcctctagcaggctttttatttttgagatggagtctcactctttcgcccaggctggggtgcagtggtgcaatcttggctcactgcaacctttgcctcctggattcaagtgattctcctttctcagcctcccgagttggtgggattacaggcacctgccaccatgcccggctaatttttgtatttttagtagagacggggtttcaccatgttggccaggctggtctcgaacttctgacctcagatgatttgcctgccttggcctcccaaagcacatggattacaggcgtgagccaccgcgcctatcctctagcaggctttttaaaggtcagtgttcaatttggaagtttatttattcagctcattatcattgggcgtctaggttatttctgatcatttaccattatttacaaaaatcccctgagaatgaacattcttgtaatagaatttttttttacatctttgattaagttttaggctaattcacagacgtggcattgctgtgtcaaaggaaaatgcacccttattcccccaaattgccttcccaaaatcattagccagtttaccctccccctgacaatgtaatataacctgttttccctcctgatacatgttattgaaatgtttttcaatttattttaatatttgttttaaaatagttatcttgttctgatttaatatgttagtgaactttttttcataatttttggttagttatgttaattttgttctaaactattcttttccacatggttagccagttttttcaactccactggttaaataaaatatccttttactattgattttaagtgttgcctttttcatatgttaagtatttatatacttggtttcatttttgaattttttggttttgttccattaagttgtagctgactgccacagcactcctatatatttattggttgtgttgtatgttttagtatctgaaagggcaaaaaattactctttctctaatttctcatggatggcctgattgttttatgtgaactgtagacttcccaaattctaaaaaacattattttgatatttcagatatttcattggaattttgttgaagattactttgggataaattgtcatttgtagtctttccagtcatgaatatgacatcacactagttattcaaatcggttgttgttgttgttgttgttgttgttgttgagatggagtcttgctctgtcgcccaggctggagtgcagtggcaccatcttggctcactgcaacttctgcctcctgggttcaagtgattctcctgcctcagcctcctgagtagctgggattacagttgtgcgccaccatgtccaactaatttttgtatttttagtattgattggatttcaccatgttggccaggttggtctccaactcctgacctcaagtgatccacccacctcagccttccaaagtgccgggatcacaggcgtgaaccaccacgcccgaccaacagttctttttttatatattcagctcttcctcattaaaaactttaagttaatgagcagtgctattgtagtgctggaatctctttttgggtgggtgaaataaatctttttgaactcatcatatatccccactgcccttataagcatttcctgcacatagttaacaggtaataaacatttgtggaataggtggatcttttcaaatggaaattattataggaaacttacaagaaaaaaattctagattctagctgttttctgttcttctattaatcagtatttaaatatttactgagaacctaaggagtaatgaatgatcacaccctcttacgttttcttaatacgtcagtttatagactagagccaccagtgtttaagctctaacaacttattacagagaatcgagatatcctttccaatcgaaagggattttttgatagtgaagtttcagcttcttgcttttgtcaatagctttgacacttggtttctgtgtgtattgattttatgactcagtactgatgtgcatgggggtcttgtttgcaaatctgtagttactctgttttaattgccttgaaattctctttagaatcactcaaaagagggaactctgccatccctttgtacctttaatttgtctcctcatctcggctacctagaaactatgatcttttctgtaagttatatagtattgtaaaggaaaagacaggtaaggatgccactgcttattccaaatttagatattcatagaataagtaccttccagaccctcaaagaactatttgtacaggttaatacatgagaagtagacttaggttcttcctttgatacttaaatttcaaaacacaggattagtaatatttagctacttaagtttggttcatttgctaaaagaagaacatttaccatctcaggccctgtattagaaggatctttgtgtctgtgagagaaaaggcagaatggagtttttctatcataattgaatccgttttgccttgcacacccctttggagcatttgatgaaagcagtggacttcattagaaaaatgcacatgggctcaaacacatacatttttgcgcagcgacgtttctggccttcttgaaacatatctgtaagcccaaacccctgtaggttttctgaactccatctaatgcagccaacaaaggggaaattttaaatggggcctgtaacaacctttagcctgcgttccttcaggtttcttcactggctgttcatagcctgccctgctggggttttttcttctacccagcatctaaaagttggacttgctccagattcttcctgggtcccttcttttcccctgcttactctgggggtctcttcctttcctctggatttaaataccatggtattgttgatggctgccagatttataacagcccggatctattctcagaatgctggaatcccatatgtaactgcctcctcaaaatcttgatttggatatctcatagatatcccttatatgtagcagataaaaattgttgcaaacttttaattctttctttctttctttctttttttttttttgttgagacagagtttcgctctatatcccaatctggagtgcagtggcacgatcatggctcactgcagcctcgacctcctgggcttaggtgatcctccccacctcagtctgcagagagtagcggggactgcatttgtgtgacaccacacctggctaattttttaaaatttttgtagagatgaggtctcactatgttgccctggctggtctcaaactcctgagctcaagcagtcctcccaaagtatgctaagattacaagcgtgagccaccactcctggcagcaaactttaaaaaatgacagctcattgagatacaattcacataccataaaattcactcttttagagtgtacgattcattgatttttagtacattcggagttctgcaaccatcattaccatttaatttcaaaacattttcgtcacaccataaagaaatcccatacatggtagcaattactcctcatttgccactcccctgtgcccctggcaactacttatctccttcgtgttgctctgttgctctggatttagctttctgtacgtttctggggggttttttgtttttgtttttgtttgtttttttgagacggagattcagtctagttgcccaggctggagtgcaatggcgcgatcttggctcactgcaacctccgcctcctgggttcaaacgattctcctgcctcagcctcccgagtagctggggttacaggcatgtgccaccacgcccagctaattttgtatttttagtagagacggggtttctccatgttggtcaggctgatctcaaactcctgacctcagatgatctgcccatctcgcctcccacagtgctggaattaacaggcatgagccactgcgccagccagctttctgcacgtttcatataatacgtaacctttttctagcttcattcacttagtattatgttttcaaggttcattctgtgttgttgtgtgtataaacatttcattcctttttatgaccaagtaatattccattgtatgggtgataccacagttgatggtacaaacatgtttttgctgaagctctgctgcatgagtggtgggaaatttaaagccacagaatgtgaaaattaggtgatatcatgtataatttaaattgaatataacatcacaaatacttatatttagagcttgagatgattaaaaattgtgttaaactagcttttcccttacttttccagaagaacacaagatgtgacactgtagtcactttttaacctgctgtgaagtctcaaacatatttgtgatattttacttttggaaagataaactgttttcttgtttttctcatgtatggttagctgcatctgtttacccattttaaatcaattttgtataaaatatttcattgttctaggacaatgggtttaatccctagttcatattctaataacttttctttttaaagtttgaaataaggaatcattttcagtgaaaaactgtctttgtgcttaaatgacattttttttgacagaagcatttcactgtgtattaaatgacattattgaattgcattataaaatgccaaactgttgagacagaattttattttctttatactttgaagtttggtattcatgaatacatgaaagcaccaaacatttactttgaagatgtacacataaaactgtatttatttgaatgagaacatctaaataaatcagtaggatcatctaaatattatttttaattataattgcagtcattagtcttgattaaaaattgtcatcattttctggctgggtgcggtgactcacacttgtaatcccagcactttgggaggctgaggcaggcggatcacctgaggtcaggagttcaagactagcctggcaaacatggtgaaaccccgtctctactgaaaatacaaaaattagcggtgtgtggtggtaggtgcctgtactctcagatacttgggaggctgaggcaggagaatcctttgaacctgggaggtggaggttgcagtgagccgagatcgcaccactgcactccagcctgggcattaagagcaaaactccatctcaaaaaacaaagaattttactcattttctgaaaccatttagaaatttcccaaaacagatcattggttttctttgtcatgaaagaacatttataaataagtaataaatgggcttttaaaaaatttagtaattttataaggaaattttttttttttgagacagagttttgctgttgttgcctagactggagtgcaatggcatgatctcggctcactgcaaactccatctcccgggttcaaatgattctcctgcctcagcctcccgagtagctgggattacaagagcccaccaccacgcctggctaatttttgtatttttagtagagacagggttttgccatgttggccgggctggtttcgaactcctgacctcaggtgatctgccctgccttggcctcccaaagtgctgggattacaggtgtgagccaccgtgcccagccaggaaaatatttttgactatggacattaatatgaataagctggccggtgcggtggctcatccctgtaacccgagcactctgggaggccaaggcgggcggatcacctgaggtcaggagttcgagagcagcccggccaacatggtgaaaccccgtctctactaaaaatagaaaagttagcaggatgtggtggcatgcaccagtaatcccagccactcgggaggctgaggcagggagaatcacttgaacccaggaggcagaggttgcagtgagccaagatcatgccattgcacttcagcctgggagacagagtgagactctgtctcaaaaataataataatttttttaaaaagaataagccaagagattgtggaatcttcaattctaaagaatataaatcatttatgactaatataaaatccagttcaagtggtgtaaagttgactttgctattagaaaagatgtctccatgattagaatttataatgaggtgtgctaataggtgaaatgacaatccccagtgcatgctactccgtccacctgttagccttctaacagggtttaagattaatgaagatttctggatggaaatcttcatgagagatggtaaatcaagattcactgagatgaaataaggggtattgtttttaggttttgtgatgggttgagcagaggtcggcatagtcacttgtttgatttgatgcacattggtggagttttaaatgcacagtgtggaagggaatgagcacttatcagaacagaaggaaatgtgtggttaaacggtttcagttgtaactaaagactatttcccttggtccaaataggaggagaaatggaaccttttgtattttggttattttccaatataagtagaaattggttcattgtggtttattgcagcccttagcagaaatgattgggttcagtagtgaaggggaatgacacaaatatgtaccaggaaagcataaatttttatttattttttatttttttgagacagagtcttgctcagtctaccaggctagagtgcagtggtgcgacctcagctcactgcaacctctgcctcccaggttcaagcgattatcctgcatcagcctcccaaggagctgagactacaggcacacacacccacgcccagttaatttttgttatttcttgtagagacagggtttcatcatgttgtcccagctgatcttgaactcatgacctcctgccttggcctcctaaggggctaggattacaggcatgagctgctgcggccagccagagggtataaattctataagtactattttaaaggtatctcagaggtaatttttttatcatgtttataattattggcagtcagttattgttattaaacatctctaaaaacaaaaagaatccaagagtctgaagagactactgaaatgagtttcaaaaaaaagatgcttccagctttttcctcaaaatgagaaactgttttacagatttttatataattaaacaggtaataaataatgccagattttagctcacaaagcactggatttcccaaaggaaatacatttggtgcaggtaaatgaaaagcctcgttaataaatatatatttgataatctgcaggtttgaaaactcactgaagaattcccacttcctctgcattaaaaataccttgttcaaggcagtaaatattaacctatgctggtttattcagaaactcatgttaaacaaggtagagaagacctaaaattatgtgttttgtttgtttatttgtttttgagacagagtctagctttgtcacccaggctggagtgcagtggcacgatctcagtttactgcaacctctgcctcctgggttcaagcgattctcctgtctcagcctcccaagtacctgggattacaggcacccgccaccatgcccagctaatttttgtatttttagtagagacggggtttcactttgttgtccaggctggtctcgaacttctgatcttgtgatccacccgcctcagcctcccaaagtgctgggattacaagcgtgagccaccgtgcccagccctaaaattatgtttttaaaagtaactattaggttagtgtggtattaggagtgggaagattgtagaaactgtaataaatttctcttatattgtttatctctatcacaataaaatattcacctcaggatgatagaattaacaccgtcctttctgggtggatagttactcttgggaacaattgtattttgagccaatatgagaattaatttggtgatcaaaaatgatctaaatttgggtatgatgtatacctaaagcaatttttattctagagttatttatttacttgaaaaagaatggtgcagaaatgggtttttgttttttgttgttgttttttattgttgttgtttcagaagaaaagttaataaaagtgtaaaacagaagttttcttttttttctctctcttttttttgtttgagacaagtctcactctgtcacccaggctggagtgcagtggcactatctcggctcactgcaatctctgcctcccgagttcaagtgattctcttgcctcagcctcccgagtagctgggattatagctgtgcgctaccatgcctggctaatttttgttatgttcagtagagatggggttttgccatgttggccaggctggtctgaaactcctgacttcaagtgatccgcccaacttggcctcccaaagtgccgggattacaggcatcagccaccgcgcctagccaggatgtaggaattttctcatgaagctgaaggttcaccagatgagagatacttttggtttcaggaatcttgaagatctttttaaaatttattggtacttttttaaactgcagtgcataaagtatagtgaacatatttaatttgtcagtgacttgagatgttaccatatcctaggatacttattttcgatatttctctaatgtgtaagtagatatacttgttggatgtgatacagtatgaagcctggctaattttgtcatctaaaggtattatgtgtaaggaataaacacatttccatttattaagaattcaagatgcttggttaagtttattcatttttttatttttatttttttactttttagaggtgaggtctctctgtgttgcccaggcaggtcttgaactcctggcctcaaatgatcctcacaccttggcctcccaaagtactgggataacaggcattagccactggtgcctagcctttttgtcttagttgattttgttatagtatttaagaatttcaacagggagttgaaataagtagattttgggttaacttaccagtttctagataaataattgatacatgtagtcaaaccctgtgaccttaaaacttttctactatatttaaaagactgattcaccttactgttgcctattgggaaaagtaaaaaataaataaataaaaaactgtgaaatagcttgaattaaatttcataagtcccatataaaggatagcagtgttttgttccgaattatttatggacacctaaagataaccacatactacttaatgtgatataatagtaaatattataccagttaaagttctttggttaaaagcagtagaaatcaactctggctaacaagacaaaaaaataaaaagaaaaaaagattaattatcaggaatctgtgagatagcttataaaactgaggggagtatcaacagcctgatcctgcatgctccaggaacccacgttgagggaagcagtgcatgctctcttcagagggtggtggcttccaattgttttccatctttctacccaacattcaaaaatcaaagtgtctggccgggcatggtagctcacgcctgtaatcctagcacttttggaggcaaaggctggcagattgcctgagctcaggagttcagcaccagcctgggcaacatggtgaaaccccatctctactaaaaatacaaaaaaaaaaaaaaaaattagccaggcatgatggtgagcgcctgtaatcccagctactggggagtccgaggtgggagaattgcttgaacccgggaggcagaggttgcagtgagctgagattgtgccactgcattccagcctggggagcacagcgaaactccatctcaatcaatcagtcaatcataattttattcatcttttctacagagtttatataagtaagtttaatctttttattttcatgtgtctgatggttttcaattattttcatccttttctgtgtcttaggtatatttgaaggctcccatgattctgaatggagtctgtgttatctggaaaggctggattgatctccaaagactggatggtatgggctgtctggagtttgatgaggagcgagcccaggtagggtaacatcaggctttattgagcatggtccctttagtccctaatcttgcctttgcctggggacctattttacccaatttttaagagtaagtatagaaagtattgtgttgaagcaatattgaggaatcctgaaaatgttgatactcaaattctgatcctgattttgggaaagttttttcttcagcagttctaaatttcatgggttattcgtatctgctcagtgggtgcttcaaagtccagcaagtagctctttaaaatatttattcttgatctttagaacactatgaatagggaaaaaagaaaaaactgttcaaaataaaatgtaggagccgtgcttttggaatgcttgagtgaggagctcaacaagtcctctcccaagaaagcaatgataaaacttgacaaaaattgtttaaaaaaaaaaaaaaaaagctggacgtggtggctcacacctgtaatcccagcactttgggaggctgaggcagacggatcacctgagacttgaggtcaggatttcgagaccagcctggccatcatgatgaaaccccatctctgctaaaaatataaaaattagccaggcatggtggtgcacacctgtaatcccagctacttgggaagttgaggcacgagaatcgctcgaacccaggaggcagagattgcggtgagccgagattgcgctactgcactccaggctgggcaacagaacaaaactctgtctcaaaaacaacaacaacaacgaacaacacccatttaaggcctcatggaagctattgaatctcagtaagatcagtgacagtctgtgtcattttagtcaggagctgctcccattccccagctctgtggtccctcaggttcttccctgggcgggcagggtaagccatgagcactggtagatctgttgtcctgtcaaagagagctgactttattaaaagcagggcttgggaaaaaaaaaatccatgcccaggcatattgtttaaaatgatagaggtctcatttgctaacagtctggcaaagctagtgttgcagaaagcaacaaaatggcagaccagccagaaatttatcagggagattcagggaaagtgataggtaaagtagaccctactaagattacactcatgtcatccagaaagctgtgtgcatgtacaaggctacacctgctctcttgaagagaacacagaaggtccttgcatgctacttttccctggatgaacacaaggtagactggcaaactccctgatctttgaaagcatttccccaagctacacacaagtccagtggcaaaagatggaagtctgctgactcaagatgtttgggtaaaaactctgaccagtcattggctgacggctgaactatgctgatccaggaacaaccccccagaaagcaagacttaaaaaagacagctgtgcgcagtggctcatgcttataatcccagcatttggggaggccaagatggcaggatcacatgagcccaagagttaaagaccagcctgggcaacatggtgagaccccatctacacaaataattttaaaaattaaccaggtgtggtggcatgtgtctgttagtcctagctacttaggaggctgaggtggaaggatcgcttgagtccaggagctcaaggctgcagtgaactatgatcatgccagtgtactgcagcctgggcaacagagtgagatcctttctctaaaaagaaaaaaagagaaaaactgagcagtgacatcagaggctgtgcactgctgtggaaaacagactcctcagaattagtccaggcgagtcactaaacaaacaaacatcaacaacaagctgaaagcaaggatcagaagtcagagttgctacagtatattatctaaactgtctggttttcagcaaaaagttatgagatatgcaactatgaaaatgcaacttatacaaaggtgaaaaagcaagcaatataaactgtctttgagggggcccaagtgttggttcttagtgagaaagacttcaaagtagttgttataaatatactgaaagaactaaaggaaaattctttccttttaatgttaaaggaaattatgatggcagtgactaattaagtagagtatatcaataaagggatctaaattattaaaagaatcaaatagaaattctggagttgaggctggccgtggttggctcatgcctataatcccagcactttgagaggccaaggcgggcggatcacctgaggtcaggaattcaagaccagcctggctaacatggtgaaaccccatctctactaaaaatacaaaatcagccaggcatggtggcgcatgcctgtaatcccacctactcaggaggctgaggctcaagaatcacttgaacccgggaggtggagattgcagtgagctgagattgcaccattgcactccagcctgggcaacaagagcgaaactccatctcaaaaaaaacgccgagtgttgtggcatatgcctgccatcccagcttctcaggaggctgagttaggagaatagcttggacccaggaggcagaggttgcagcaagccaagatcgcatcactgcactccagcctgggcgacagagcaagacttcatctcaaaaaaaaaaaaagaaattctggagttggaaagtacagtagtaacaaaaagttcacagactaaatggtagataagagctgacatatgaacaagaaaaattaacagtcttggggacctgtgggacaccagcacacgtattaacataaatgtaatgaaagtttcaggaaaggaaagaaagaggttgaagatacattttaagaagtagtagccaaaaactctcacgtttgatgaaaaatattaatccacattgtccaagaagctcaatggacactaagtaggataaacacaaagaaatccatacctagtcacattataaactgttgagagacaaggaatcatgaaagcagcaagaaaggattcctcacacgcgaaggaaccacggtaagattaacagctgacttctcttgaaatcatagaggctagaaagttgtgggatgacatattaaaagcaccaaaagaaaatgtaaaagcagattgggtgcagtggctcacacctgtaatcccagcactttgggagaccgaagtgggaggatcacttgagcccaggagtttgaggctgcagtgagctgtgatcgcaccactgcactcaagcctaagtgacagagtgagtccctgtctctttaaaaacaaagaaaatgtaaaagcacctgattattagcaggtattaatgtcttttaattgtttgcttgatattaaccttaataaagttaaaataataacaggaacataaagaaactctttgtttctttgttgtatcttcccatatagttctttatatatggaaatgtaagaattttctttaaaggagatcaaaaaattaaaactttctagtgaaaagcttaggattcaaagttaaaagtcttaagaaagaattcttggtctggcccaggccatcccagtggcacatgcctgtagtcctagctacttgggaggctgaagcaggaggatcccttgatcccaggagttccagcccagcctaggcaacataatgagaccttcatctctaaacataaaaataaagaaagaatccatgcactaccctgatttccacaatgctaatgaatttccaattctttcagaaaaataataaataaccagcaatctaaaagtctattttctgttaagaagtgataaagcagactttatttatataaggaaaattcagattggattgacttttaaaaaactaaagtattttgacagggtgcagtggctcacgcttgtaattccagcacttggaaaggcagagatgggagtattgcttggtcccaggagtttgagaccaacctgggcaatgtggcaaaaccctgtctctaccaaaaaaaaaaaaaattagccagctgtggtggtgtgcacctgtagacccagctactcaggaagctgaggtgggatgattgcttgaacccaggaggctgagattgcaatgagccgagatcacaccactgcactccagcctgggtgacagagcaagacaagaccctgtctcaaaaacaaacaacaaaaactaaagtattttattaagataataggttaaaatttttaacattttttatacttggagttttccaagccttatttccatagtccccaaattgaactatatcactacaaattaagtgccatctgttgtgatagtttactactatcacaatggagttacataactcttaccgataataggagttatacagtgtatagtaaaaaaaattcagagcaggtgactccaactatttaggcagcaatcagtacttccctgtagctccccttgtccccatctgcaagataatataagtaaagaagcaatgaaatgtagatgctaggggcaggagttcatagtcgtataatgtgaatcctggccccactacttaccagctctcatgaactgaatgtttgtttaccccatccccaaattgatatgttgaagccctactcccgttgttactgtacttgaagatagggcatttatggaggtaattaaggttagataaaggcgtaagagtggggctctgatccagtagggttagtgtccttaagagacaggagagagctctctgtctctctctctgccgtatgaggacacagtgagaagatggatgtctgcatgccagaaagaggttcctcacggggaaccaaattggctggcacattgatctgggattgctagtctccagaaatgtgagaaaataaatttctgttgtttaagccactccatttatggtattttagtatggcatcctcagatgactaaaacactagctgtgtgatgctggcaagttattaaatctctccaggcctcagatttctccttcctaagatgggataatgctgcccacaagattgtgggcagttgaatgggatagcatatgtaaagggctgtgcctagcacagtatctagcgtgcagtacagttcctaaacaaagactcttgtttgttactgcttgtactttagcattttatacttagggtttccactcttctccagatgtctgtcttgtgaagtagtgtgtaaaatcacaaagcatggatttcagccctctttcactgggctggaataggccccatctctagcgagtgagccggtggcagcctcacttccatggcccaacacagctttgtttctctctgctgatcacacaggcagaaataactcttctgaattaaccaaaaaacagttttttgaaaagttaaagttcatggttaatgttatatcattcataatgtaatataatttgatataggatgagagtgaccatattacttattgtaactgtattattcctaaaagtataaggtcatgtttaactgaaattatataatattttgacccacaaattgattttattatattgctagccctagaaaaattgtttcattcaaaaaacatttttaaaaatacgtttttaaataaaacaacatgtgcacattacagcaaaataaaagttatatctttatgctaatcttctgaacattaagattaataagcagaatacttagtcttgatatttattcatgcactttattagtctcttatttatatctgtatctaatatttttctgaagaatatatagatttttcaatatggtcttgtttttctttttttttcttttttttttccagacagagtcttgctctctcaccccggctggagtgcaatggcacaatctgggctcacctcaacctccgcctcctgggttcaagcgattctcctgcctcagcctcctgagtagctggggttacaggcatgtgccaccatgcccggctaattttgtatttttagtagagacggggtttctccatgttggtcaggctggtcttcaactcctgacctcaggtgatctgcccgcctcagcctcccaaagtgctgggattacaggcgtgagccaccatgcccggcctcttttttctttttttttttttagcgacagagtcttgctctgttgctcaggccagagtgcagtggtacaatgacagctcactacagcctcaagctcctgccgtgcttggctaattttttttatcttttgtagagatgaggtcttaccatgttggccaggctggtcttgaattgctggcttcaaacgatcctcctgccacagcctcccaaagcactaggattataggcatgagccactgcatctagccccttacttttattttcttcataaaagtgcccacaatatgcttcagagttgcatattataattagtaaatttggaacagctgacatcttcaattgagtgtctgtaaactacgtaaaaaattgacaaaatactctaacaaatgctgaagtatctggtaaactaagagctaaatggaagagagtcaattccatttttgaaagattaaattgtataactatttcagctgaaatattttcacaggtattgtctctgcttttgtccagagtgcctttctttgacaagtttggtataagacaatacctgtcaaagctgtctctatttatgattctgtctctatttatgattcttctgaaaattttgccaagttcagttacttcagaatcaaatcatttccagttaaaaatggaattccatccaagattcttttcccaaaaagaaacagaagacatgtgaccagatgcagtggctcatacttgtaatccctgcactcttgagaggccgagacaggtggatcacttgaggtcaggagttcgagaccagcctggccaacatggtgaaactccgtctctactgaaaattcaaaaattagccatggtggtgcgtgcctgtggttctagctactcaggaggctgaggcaggagaattacttaaacccaggaggtggaggttgcggtgagccgagatcgtgccattgcactccagcctgggcagcagagtgagactccatctcaaaaaaacacgaggccgggcgcagtggcttatgcctgtaatcccagaactttggaaagctgaggcgggcaaatcacctgaggtaaggagttcgagaccagcctggccaacatggtgaaacccgtctcaaccaaaactacaaaaattagccgggcatggtggagggcacctgtagttacttgggaagctgaggcaggagaatggcatgaacccaggaggcggagcttgcagtgagccaagatggtgccactgcactccaagcctgggcaacagagcaagactccatctcaaaaaaaacaaaaaacaaaaaacaccaagctgttatttgcagaagatgcatgtacttagaaaatctaagataatttacacactattaagaaaactaacacatgaatttcacagggcattagatgtaatacaaggtcagtacaccatcagttacatttctatataccagcaataaacaaagacaaaggtgacactgcagtgcagacaagggtggggggcagggggtaggtctcttcagtaaatgatgctgggacaataaaacatttctgtgaggggaaaatatatcagagccccttataccattcacaaaaatcaatttcagatggatagcagtttataaaatgtaaaacagtaaagctttttttttttttttgagacagagtctagctctgtcaccaggctggagtgcagtggcgtgatctcagctcactgtaacctctgcctcccgggttcaagtgattctcctgcctcagcctcccaagtagctgggactacaggcacgtgccatcataccctgctaatttttgtatttttagtagagacgaggtttcaccatgttggccacgctggtctcgatctcttgacctcatgatccacccgcttcggcctcccaaagtgctgggattacaggcatgagccactgtgcccggccgaaacagtaaagctttttaaaggaaaatgagaagatcattttgtgaccttggagtaggcaaaaacttgaacaggacacaaaagatgctaaactgtaagtaaatggataaataacgaattatggtaaaaccaagaactgtttatcaaaagacagtattaagagaatgtaaaggcaacctgaacagtggtggaaaatgttttctggcaaaggacttacataaaatatgtagaggccaggcgcagtggctcatgcttgtaatcccaacactttgggtggccaaggtgggcagatcacttgaggccaggagttggagaccagcctggtatggcaaaaccccatctctactaaaaaatacaaaaattagccaggtatggtggcacacacctataatcccagctactcaggaggctgaggcaggagaagcccatgaacctgggaggcagaggtttcagtgagccgagatcacgtcactgcactccagcctgggcaacagagcgagattctatctcaaaaaaaatgtgtgtgtgtgtgtgtgtgtgtgtgtgtgtgtgtgtaaagaactcttacatttcagtgagaaaatattttcattgaaaggaaacacagacaacctaaaagaaattggcgaaagacatttaacaggcagttcacaaacaggctatgcaaatgaaaaggattcagctttcttggatcatcagaaaaataattattaaaaccacagtactaccacacagtcatcagaatggttcaaatgaagaagacagtaccaaacattgacaagaatgtagagcagcagttggtgtgttggttatgtaagattggcacaacatttggaaaactggctgtaaatatgcaagctgcgcatgcatatatgtgtgtgtgtgtgtatatatatatacacacactatgatctagcagttctactccaaggcatgatggcaacaggagtgaatatgcatattcatcacaaaatatgtgctaggacatttataactattattagtaatagctagaaattgtaaactgcgcaaatggccattaacagtgaaatttataaagtgcgtggtcacacaaatacactgagaatgaaaagctacaactaacaccaatatgtgtgagttcctcaaaaatattgagagtacagaacaggccagttatggtgcctcacccttgtaatcccagcgctttgggaggccaaggcaggagggttgtttcaggccaggagttgaagagcctgaaatttaaaaatttcaaaaatttttaaaaattaactgggtacagtggctcatgcctgtaatcccagcactttgggaggccaaggtgggcagatcacaaggtcaggagttcgagaccaccttggccagtatggtgaaaccccgtatcaactaaaaatacaaaaattagctaggtatggtggtgggttcctgtagtccaagctgctcgggaggctgaggcaggagaatcgcttggacccgggaggcagaggttgcagtgagctgagatcgcgccactgcactccagcctggtgacagagctagacttcatctcaaaaaaatttaaaaaattagccaggcatggtggcatgcacttgtagtcctagttacttgggaggttgaggtaggtcgatcacttgagcccaggtggtcaaggctgcagtgagccatgattgctctattgcacttcagcctgggcaacagactgcctcaaaaaaataaataatttaaaaaacatcacatgttatatgaatcgatttatgtaaaagtacaaaatcaggtaaaaccaatacatgtttttccccccatttatttctttttatagaaagtaaaaaagaggcaaaattaagcaaaatgcctcttggtaataaataataggaaagccataagtagtattcacaaaattatggatagtggtcacctctaggaacaggagggaaacagggtagagcagcacagaaactgaaatgcccaaagtctcaaactcctgacctcaggtgatctgccacacttggttttttaatataattgtctaaaagcttgaaaaatatgaagattttggcactttaccattgaataatcagagatttccaactaattttaaacaaaactttactacaaagactcatttaccaaaagaaggtcattgttattgtaggaactaggttggttttagcatagttcttgagactcaagttttctaaaaatccagtgtgtactgtcatgagattagtttttttttttcattgtcagctttgtcaaaattctgcagttcagttactttaactatggatatataaagatatttgtaagttatataaactataacttctaaaggatagaatgtttcatttctttggatgcagttataaattatatgtgtaccactactagttcctagtagatttctaattcaatgagaatgttattttcttatacaatatgtgttccaccaacatttgtattaccaacataagccaataattttatcttcattgttgtactttttaaatgactttgttttggcaatcacaaaacaatatttcacgttcagtataatgaccttgcaaagttttatttgattccatgattggattagaaaaattgaaccattattggaattgatgcattttctgtttgaagtacttgatgacactgctgtaaaattagtgtctttttgtttgcaaggtttttctgttcatgaagcaacgtataaacagctttactttttacatatgcacaaaaacgtgggtgaaattaatttggaagagtcatttaagtgaaaagttacgtgctacagattgatgtgttaaatgtaccatttgcagctgcacatactgattgtcttttatgtaaatactgatgcttcttcagcagatttatttattttggttttcatgtgatcagtgataccattctggtccccacagagaatagtaaatgtcgatattttgtgcaaattagatgttcatcatcaactgtcttggaaaaaaattgattcttaattttttaattaagcatgaacttccagtttttaaactctgatgcagaaaggtaagtgttaccgaactgttaaatatatatagttgtagatttagacaataaataaagacacaatttaaatacagtgaagagagaattactacaacaagagtggtcgaatattctgtgtatgctctatgacagaactgctaagcctttattttccacatggatttaatttacacccagccatgttttatgatgaccccacctggctacgttgtgcaggttgtggtatagactttggagtaacagactagtagtataacaagtggctggtggggacgggagaattgaaaaccttatcctacccgaacctgaatggagttggttgttcctagccatttgagcctactttgtgggtaagcacgtggtttttattagcaggtgccctttatgctgtccttgaaagggaggtgttagattgcagcaggaaaggatcaggataatactggtaattgctgattgtctttccattttaccatttgttaaagtgtgaactctgttcactgcacatatgtctcacatgtcattagaaaataccaagacaagctgggcacggtggctcatgcctgtgatcccagcactttgggaggttgaggcaggaggatcacttgatattgggagttcaagaccagtctgggcaacacagcgagacctcatctctctataaaaaatttaaaaattagctctggtggcacacacctgtagtccctgctacttgggagcctgaagcaggaggatcatttgagcttgggaggttgaggctgcagtgagctataatcacaccactgcactccagcctgggcttgagagcgagaccccttctctaaaaaagagagtaaagaaaagatcaaaacagaagatggaacaagaaagtgaaggctaccaaatatctcctggcttattttgctgcaaatattaataatgatactttttattcttgttttgaaatggagtttcgctcttgttgcccaggctggagtgcaatggtgtgatcttggctcaccgcaacctctgccttcaggggttcaagtgattcttctgcctcagcctcccgagtagctgggattacaggggcctgccaccatgcctggctaattttttgtatttgttttttagtagagacggggtttcaccatgttggccagggctggtctcttcaactcccaaactcaggtgacccaccggccttggcctcccaaagtgcttgagcttataggtgtgagccaccgcaccaggcccacagttttttcctgtcatcggcagatgtgtcccagttgatacctaagtgcatagaaagccgtgggaaattgggaacagcattcttttgcggctacctctggcttatattatgtcctgagaatatagtaggtccatgttatgatgttcagtcaaatgtttgaattttatgtatccataagtgcttgttgaataatagcatttattgaatgctgtcagtatgcttaagcactttttatgtgttatttaatctttacaacaatcttgttataaagtattactatgcctttcttacatgtaaatttactgaggcttagagaaatgaaataacattgccctgggttataaagctagtaagtgcatcacaagaatgggaatttgattacatctttccattctgtttacgttatagacattgtcactgaaaattttgagtattagaaaaccccactgacagtgacaaataaaggatttatcacacagaacaagatatccagcagtacacagtccaggcctggtatagcaagcacttaattatgttatcagaggccctgggtctttttttttttttttttttttttgaccccaacgtgatatgaggtcttttaatcttgctgctgtaccatgctcattgtgtgactgtgtcctcattattatgtttgcaagatggctgctgcatctctgagcactgcatcagttcctaagaaggtggaatggtgaaatgtctcaaactttcttggaagccccattaggtgacttgtgtttctgtctcattggctacaactgagttacgtggccaccccttgctgcagtgaatctaggaaagtgagtagtattgatgacttttctggtattgttttggatcttttcgtttcttcaagtgtaccatcaaaaatcctggtattctggccagacacagtggcttacgcctataagcccaggattttgggaggccaagtcaggcaaatcacttgaggtcaggagttcgagaccagccgggcatgatgatgctcacctgtagtcccagctactcgggaggctgaagcaagataattgcttgaacctgggaggttgcagtgagcagagatcacactgctgtactccagcctgggcaacagagtgagactctgtctcaaaaataataataataataaattctagtattcagaagtgtgtgacggcaaaggccaagcatcctgggctgtacacagtgagggagcttttttaagttgggggcattgtagtcagattgtgctttaaaggcatactccgatggctgtgtggtagattgggttgaggagtgaccaaatggaagcaaggagagactgttgaggagacttttgcaatggtctaagtgagattttaggggtctgaactaggaggaaactttttataggaatgaagaggagactgaagattccaaaaatatataggacatcaagtgggtaggactcagtggttgattgattgtggagacaatgagagagtgaagagtcaaagatgatggctcaggtttcttgcagaaaaaaaaatggtgccaccaacagagaccaaaaaagagtagagaagaaagtttaagttggttacctttttagatgcaatgagtcctgaggtatctgggtttccttcaggtgcagatctttagccactaactgggaaaagacagatttgttatatgttaataaatatattttccttaataatttcccttgagattttatttgctttttgttgtccagaagtttccaacatttgtgtagtcagtgctgttcatcttcatttatatttctggctttagttcatagagcatttcttttccccaaatgatagaagtatttaccacatttgttagccttaaatattgtattcatcaggattttattttgatgagtaggattaagtaggtaaagaaaacggaagagcattttcagttgttagaatatgattaacatgacttatgtttccaaggtgtggcataaaatatgaaatactgaatttttcttttaaaagtacctctgacttttttttatatatatacttttaagttttagggtacgtgtacacaatgtgcagattagttacatatgtatacatgtgacatgctggtgcgctgcagccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcagtgtttggttttttgttcttggcgatagtttactgagaatgatgatttccagtttcatccatgtccctacaaaggacatgaactcatccttttttatggctgcatagtataaatcatgctgctataaagacacatgcacacgtatgtttattgtggcactgttcacaatagcaaagacttggaaccaacccagatgtccaacaatgatagactggattaagaaaatctgactttttttttaatggtgttgatgtttcagaaatactctgctgtttgtttctgtcggaataaaaaaggctggacaaggtggcttgcacctgtaatcccagcactttgggaggccaagacgggaggatctcttgaggccaggagtttgagaccagcctggtcaacatagcaagacccagtctctacaaaaactaaaaaaaaaaattaaccaggtgcagtggtgcgtgcctgtagtcccagctgcttgggaggctgaggcaggagaattgctgtaatggggttaagcctatgattttcaggttgtggtgagctatgattccaccactgcacttgtactccagcctgagtaacagagcgggatgctgtttctttttttttttctttttttttcttttcctttttttttgagacaggctggagtgcaatggcgcaatctcggctcactgcaaccttcacctcctgggttttaagctattctgcctcagcctcccaagtagctgggattacaaacatgcgccacaacatccagctaatttctgtatttttagtagagatgcggtttcaccatgttggtcaggctggtgtcgaactcctgacctcaagtgatctgcccgcctcggcctcccaaagtgctgagattacaggcgtgagccactgcgcccggccactgtttcaggaaaaaaaaaaaaaaaacaaaacccaaatattgtattttttttataaatcaaaattaaaataggtatttcatgtattctgacagcaggaggatgcattagcacaacaggcctttgaagaggctcggagaaggacacgcgaatttgaagatagagacaggtctcatcgggaggaaatggaggtgagagtttcacagctgctggcagtaactggttagtactttcccccaaactctcaggctgtgtttgtgatgtttgtgcataatgctttttaatagtttaattttgtctttcatttttaaaaagttgtactctctggctttgtgtttattaaatgtaattgctataaagaaatttattttaattttaaagttgtacatcaattcctcattcattggtcttcataaaaatcatttactataataaggtatattttctcttaattcatttactcaaaatctcacctctttttttcttatttttcaaattatttgtaaaaatcagcttatgttaacagattgcatatttttagaacattattaaaactcgagtaatactactttccatttttctatgaatatttgtcttggttttataactataattgtcagtcatttgtgtgattttaactaaaggaaaatttaatattcaaactattcaaagaacggaattaaactttttcttttaacctttctattgtaaaatacagaaacagaaatcaacattaacaaatctgtagcttcctttgctggtttacttaggatacattttttaaaataataataaataaaaaaatctatagcccaatgaattactgtaaggttaacatccttacaaccacggtttggtcaaaaaataaaactttgagcctgagcaactctgtctctacaaaaagtaagaaaattagctgggtttggtggcacatgcctgtagctttagtcacttggtaggccaaggtaggagaatcacttgagccctggagtttgaggttacagtgagcagtgattgtgccactgtattccagcctggatgacagagtgagatcctgcctttaggaaataaataaataatacataaataaacctttgacagctaccccagcagccccttccatatatacatctaatcatgactttctcatgatttctgctcaaaagtaatcattattttgatttttttttttttttgagatggagtcttgctctgtcgcccaggctggagtacagtagcgtgatctcggctcactgcagcctctgcctcccaggttcaagtgattctcctgcctcagcatcctgagtagctgggattacaggcgcacaccaccatggccggctaatttttgtatttttagtataggcagggtttcaccatgttggtcaggctggtctcggactcctgacctcatgatccacccacctcaacctcccaaagtgcttggattgattacaggcgtgagccactgcgtctggcccattatttcagtttttatagttaatttatgtcttgtgtttctttagttttagcacccattgaagtttagtcttgcccagttttaaaatttgagcttttttccccccacttttttaaatctaccatgttggtttctgaattttgatgtgtcttttaattgacaatggaattttaatttttttacacaaaattgtactctgctttaaacagacctcaattataaaaattaatattcaaagtatatacaaattgttcagaaatacagattttctttaaaaattatattctagggccagatgctatggctcacacttgtaatcccagcactttgggaggctgaggtgggaggattgcttgaggctgggaattttagaccatcttgggcaaaatagcaagcccccatctctgcaaaaaataaaaaattagccagcatggtggcacatgcctgttgtcctagctactcaggaggctgaagcagggggatagcttgagcctaggcgcttaaggctgcaggagctatgatcgtgccactgtactccagcctggatgacagagcaggaccctacctcaaaaaaaaaaaaaaaaaaaaaaaagtatattctagcaaaaataatcaagataagaactaatgtgtttgaaaaagagtgttgtcaaatgttactgtatatcatgcttcaagtttataaactttgtatcaacatgaacatttcatacaagaagaaatagaaaaagcacacattcatctttgataatcaaaacacattaaaatataattataatatatcaactaaacagaaccatttccaggtgttaaaaatcagtattaggtacctaagattgttaaattcatgtcctatatacttttggaatctacagacagtagaatagtggttgccggggaaatgggggttagttatttaaagagtatagagtttcagttttgcaagatgaagagagttctagttggttgcacaacagtgtgaatgtacttaacactactgagtgtatgctttaaaaatggctaagatggtaagttttatgatatgtgtatttcaccactttttttaagtttttaagtcaatgttacataatgaagaaaatttgtggtttttttccaagcacaaaattatatgtacactattgtttaaattaaggtgtgtgtgcatacgtgtgtgtgtgtgtgcgtgcatgggtgcagacagtggctaagagcccagactctacagccagacagaagtctgaatctggctctgtcatttactttgtcagcttggacagcttacttcacttttctatgactgagtttcctcatctacaaaataggagtaataatcctgcctgtctcatatggtcattgtgaggattaaatgagtaaatacatgtgaaaccacttttagcgtatgtgccactgactaggtgtcaggtgctattattattgttaatattatttaaagtattacataaaatttctagttgtgttaaaatatatttacttagaatacatttaaaaatcaagcctatttggtggttagtgtatgaaataaattgtgtgtgtgtgtgtgtgtctctgtgtgtgtctctgtgtgtgtgtgtgatggagtctcattctgtcgcccaggctggagtgcagtggcacaatgtcggctcaccgcaacctctgcctcccgggttcaagcgattctcctgcctcagtcttctgagtagctgggattacaggttcctgccagcacgcccggcaaatttttgtatttttagtagacacgaggtttcaccatgttggtcaggctggtctcaaacacctgacctcgggtgatctacctgcctcagcctcccaaagtgctgggattacaggagtgagccaccgtgcccagacttgaaataaaatttaatatcttttttttgggtgggggtggggggagatggggtctcactctgttgcccaggcagaagtgcagtggtgtgaacatgattcactgtagcctcaacctcgtgggctcaagcagttctccctccttgacctcccaaagtgctgggattacagatgtgaaccactgcacccagcctaaaatttagtatcttttttttttttttttttttttgagacggagtctcgctctgtcgcccaggctggagtgcagtggcgcattctcagctcactgcaagctccgcctccctggttcaagccattcttctgcctcagcctcccgagtagctgggaccacaggcgcccgccaccatgcccggctaattttttgtattttttagtagagacggggtttcaccgtgttagccaggatggtctcgatctcctgacctcgtgatctgcccgccttggcctcccaaagagctgggattacaggcttgagccactgtgcccggcttaaaatttagtatcttttagtgattgctagatctctttgtcagtgagttaattaatctaatgggctgatagcagctgaggatgtccccaagaatacttgttagctaagagaagaaaatggagggatatatgtgatacttgttttctttgatgctgttgtaattcttgtgattttcatatatgtgaatacaagacttccacaccatgccctttctttcggtatctgtaaaatttagaagctttaaaatgtataatgtacatttgttacatttctgaacctttttgctcatgctctttgttccctgatgtagaatgttcttttctgtccgtcaaggcccaacctgaatgttgtcattaaatgtcaggcctttcctcagtcttcttagtcataatcataaagcccttccattctgtagcactttttatttctactagtgttcttattgaacaacatgttgaaacaattataaacatttgtgccctccactttatggcaatcccatgagatggagcccctgatttttgtgtcttccacattacctaccacaatcctttgtacactgcttagttgttcattggatatcttcaaaaaacagcccctatcctgcctgtctgaaaactagaattataggagagcctgctatgatagttcatgtagataatacatattaatggtctctggaaagattctaaatatttataatgtgttggtttatattaactagttaagtaaagtaataaaccccaagtgtgttggtctgtattctgcattagggactgagaaatatatagatgaaaatgcattgtttctgtctttgatcagctgtcagtcttgtgggaaaatgatggataaacagatcattgcagtgtactttagcaaccaccatacataatggaggttcaaaagggacagcagcagtgtagaggaagcttaagtctgcctctgcttgggaaattcacagggtagtatacttagagggatttgaaggaagagtgtgttttgccagctgttcaagttggagaaagcattctgggcaggacaaacagtgtatgcaaaggcatggaggagtaaggaggagtaagagagcctgccaagtcaagagagtgtgattggtcagtatttctggagcaagctaacatggctttaaatgaatataggaatcattttctaaaaagtgctcttcagctacattatatttggagattaactatttgacaattaatggaacaactgttgaaagcttttgtatgtattttgctttacataaaactctagattaattgactaagaattttctattctaaattgtggtggctcacacctttaatctcagcaccttgggaggctgagggaggattgcttgagcccaggagttcaagaccagcctgggcaacacagcaagactttgtctctacaaaaaatttaaaaactagctaggcatggtagcatgtgcctgtgttcccagctacttgggaggctaggtgggaggatcgcttgagcccaggaggtcaaggctgtagtgaactatgattgtgacactgcactccagcctgggcaacagagcaagaccctgtctccctgaccccacaaaaagaaataaatacattgttaatttgatttttctaatttaaaatgttggaagaatattttggtatgtgagtttatatgtatatatgaacagaaatatagtctgttgatagaagtgtcacataatttgttgctcagatagattgtttctacttgtttttttgtcagtgattgagagcatgggctttgtagtcaggcctagttgagattcctgctccgtcacttgcctcaagagccctaattttctcacagaatttgagtattaaatgggaaaatgcttgtaaagcacttagtatgatgcttggtatgtgtatgcctacagtaaataatagctctgaagtacttctttttagcactaaaagctccaccataatgctggttccagttaattgaattatttggctaacaagaacatccttttagttctctgaagtgtatcaaggcactttccctacattatgacctagagcatagagaaaagagttatattttcatcaatgatttaagatcctgtagtcccttatggcagtaatttaaaacatcagttcttgtagagaactgtcatctggaaaattgggctggaatctgactccagcacatgcactggcaatcacataggggagtttggggtttgtgtgtcttttggcacttagcgtgtatatattttgcttctttgtcttttttttccatccataaaaaattcctaatgtcaccttattttcttgcagtttaccttctttttcctaaaaagagaatattggagaaaaatgttgtttcccctctgtgattcagattatctttagagattcaaacatcatctaatctaacattattacagttgataaaactgagagtctccaaaaaattaattgacttgctctccctcaaatatttggttaatggaagaaacagtgagtatttaaaccagtttcctaaccaggaggcctgcacaaatacagcttagcgctgggaaattaatttccacaccacccgtaaagatgcttaagctgaaaaataaaatctgccaggagagattaagaaccgttttgcctggaatagaaaaggctgaggcagaaaagaaaaataatggttctagtgggtggtcctgatgcctgactggagaggagggccagagaacagtggtaactcatgggtggcagcaagtcagtaaacggcctgtggaagcttgagatcctagcagcacagaggtttagggatgtcctccactgtttggataacttctgaggcctccagccctgccatgctaaacttgtaacagtggtgctcgtgagtatttaatctatgtgtaaggttaagattactaaggggggaagcagaactccaagtggttggtggcccaaggggttttgattttcaacagtgtcttttaacctgaaactagttataaaattccttgagcattcttccatttcaccatgtgtaaaatttagaaagttttcgatccttcatgataggatttagtgttttctttttctcatttttctggaacagcctatttcagtagtacaatattttctttacctttcagaggtaatggcagattatcattaacttgaaatgagaaactatagtgaaatgaagaagcattgtttatgttagtaacctttaccaaatactcttgtcattgatatacattaaaatgatatacataaggtacacagtactgtgtataatatcttactctctgggtatttttcctactctgtgggtaatttttgtttaaatgtgcatagtcattctctagtagaatatctaagaaactggaactagaaactatgggggagaaccaggtacctgggggacaaaataagcaaattattatttttcactgtgtatcttctgtaccttatgaattttgtatcattaattatttagaaaaaaataaaatttgctttcagtattacacagaataatgaaaacagaagattctagaccttgctatctctattctctggcatataggctgttttttatgtgaaacccttcctccatttgaaattgtatacagagccccactgtataaaacagtttttttaaaaggcactgctctgggcaaagccagggtagggattgttctggtctccctctggtgtccctgggggtgtttttacggaacccagtgggtggcagaacataatgaggactctggatgtagtggaatgagcacaaggttttgcatcccggctccactacttgttgccatatagcattgagaaagttgcttattctcattgagcctcatcagtaaaaactccctcccaggttgttgcagagctcagtatctgaggcttagaatggggactcagtggaagccagtttctttaccccttctttctgtgtacttggctcacaatatatctggagtggcaggaaaacagtaaaagtagtcatatcctaactttagactatgaaagtcgaagatactattttgccaagccattttagattctggtgttttttgtttggttggttggtttggttttttaaaacaaccagtaaaggattttggacttttcttggctctgttggaggctaccagttactgtggggattgagtagtgactagaagtgggtatgaagagaacttcccatgttctggtaatgttagttcttgacctgggtgctagttaggtgggtgtgttcgctttgtgaaaattcttcattacatacttaacaatttgggcactattctgtacttgtataaaaagaaggcttttaaaaataaaaaataatcacagacgttacttttgtgaaatgctctccattggcatctgttgctatatagaagcatcctagcaccttttctgtctgagaatccttccttgatctgaaaatgttgacatgtttcccatgacctttctttttggggtatatatgtctataactaattcaaatgtcttttgtgaaggaagatggaggttaataaaggacagatttcatgctctgatcatagttgagttagaaagatagcaacttgtacactagtctctgtttccagagactgccttcaacttgattggccttttgacctaaaactgtaatatagcactcttggcttttaactcagctccaaggtgacagggtgcttaaagatattttctctattatcttaaaaatgcctacatttggttagattataaagtggcagcaaataaatggttgtctttaatgtcagagaatgggtaaattattgtttatcctactatgagcaattttaatacaattcaaatcatagaattttatgtggaaactatttggaaataaaaacaggcaaaaagttttatgtggtttttgtatttgtattttgcatagttttggggccttcaattctgtgtggtccaagaaaaaaatctcagcctctatttattttaaatttccgaagacttcagttttcaaattatttaactctaccaatattctttcttgtgtatggataaatcagcatgagaatatgtctgtgctaggccttcctgggttgtgttttgggtaatggcagtagatgagaatgaactgggagtatgaactcagactgagaatgagaatcggaagaagattaatgaaggaggaaaaggatacgaaatctgacttcccccactaccagaggaagagagtcttggttctctatcagaggagcaatagactttattaagatttatttttgttttagccttgttttagtttctaaaaattattctatctgcaggatatggatttttcaacatttgaatagttatttgaaaagttcataaatggaaatgggaagtgatgaacagctttgttataataacagcatcatgagtgcatcctatgtgccaggcagtgtacattataattttggctttatatttgatctttaaatgctcttgtaagttacctcttcattttgaggaaccgaggctaagagaggataagaaacttgcctaaggtgacatagctgaagtggtagggccatcatggtccaagcccagaaatgcagattattcccactatttcattttaaaatgttactttatatttgaagttttccttaggttgcatactttgtaagaactatattttttgacatgcctgttggaacagctctcgcagtctgcttatctgacagatgtttataattgtctgctgacttttttttaccctttttaaaatttttttttaattttactttaagttctgtgatacatgcgcagaatgtgcaggtttgttacataggtatacctgtgccatggtggtttgctgcatctatcaacccatcatctaggttttgttgttgttgttgtttgtttgtttgtttgtttgttttttgaggcagagtttcgcctttgttgcccaggctggagtgcaattgcacgatctcggctcaccacaacctccacctcccgggttcaagcgattctcctgcctcagcctcccagtcatctatgttttaagccctgcatgcattaggtatttttcctaatgctctccctccccttcccccctaccccttgacaggcccctgtgtgtgacattcccttccctgtgtgtgatgttcccctccctgtgtccatgtgttctaattgttcaactcccacttatgagtgtgagcatgcagtgtttggttttctgttgctgtgttagttctctgagaatgatggcttccagcttcatccatgtccctgcaaaggacatgaactcattcttttttatggctgctttttaacctttttaatgagtttggggaaagtgcattcctttctctcatgttgagacttaaaatttgtgctttgtgtctcctccagacttagcaatagggagaactagcagtgactaaggaggctgacattaatgccaattgtaagttaaaggctcatcttttccataggtctgattctgtgttctgactctgcctccaactatgttacttgggggaaattacttaaccttagtcttaggctgtcatctgcacaatgagagttgaatcagatctctcaagtactttgccactctaaaattctataattctgtattcagaattttatttttctcccttccttccccctgaattttattttattttttttagagacagggtgtcattctgtcacccaggctaggttacagtggtgcaatcttttttttttttttttttttttttttttttttgagataaagtttcactctgctgcccaggctggagtgcagtggccagatctcggctcactgaaacctctgcctcctgggttcaggcgattctcctgcctcagcctcccgagtagctgggattacaggtatgcaccaccatgcctgagtaattgttatatttttagtagagatggggtttcaccgtgttggccaggctgatctcgaactcctcacctcaggtgatctgcccgccttggccttccaaagtgtggggattacaggcatgagccaagtggtgcagtcttatagcccactgcagccttaatatcctgggctcaagcagttcttgcctcagccttccaagcagctgggattccagccacgtgctaccatgcccaactaatttttaaaaattttttgtaggggcaggatctcactgtcactcaggctggtcttgaacttctgggatcaagtaattgttccacctcagcctcccgaagtgctgtaaactgtaggcgtgagccaccatgcccagctgttcttttagccaagtatcaaacaaaaagtgaatactacagtatctggacatagtacacactcaataaaatatagttgtttttaattgttagggaattttcccatgaagagttttcagcaggttttttttttttttttttttttttttgagctctcaatattaaaagaatggagatcaaccaggaaattttcttcattctggataccccctcctcgtggctgtttctgcatagctctgaccagtagggaaaactcaagctgctggtgtgtgttctttcgtctcatttggagtcatctcatgactgcctcctagcaactctatttgccttgttcctgggagatgatatactgagagaaaacaggagagcaactggtagtaagaggtctgtagcacaaggttgagattaattcttcataaatactaagaacagatttgtgctctgaaatcagactcatggatgtgtgctttatattaaaaccccaattctgaaataactgttactaaaaggttagaatcaaggccctatggctgaggagaaggaaactagaaattacaaactttgtgcttttaggatgatggagttcagagtttctttgccatcatgtagtatagtttacccatagaggaaatccttcaaaaaccttcattagaaaactgccacagtaagaagtcctgcttcttaaagcagctgcttattcagctgttaagttctactcctatggaagctattttactgaacctaaatctgtttctgtatttgtttccttcatatgacggtcaatacatcttcccttctagcattaaatgtcctcccagatctctcattcttccctcttctgctctcatttgtactgttagacttcctccctctttttttttttttttttttttaaagagatggggatctcactatgttggccggggtggtctggaactccagggctcaatcagtccttccacctaagcctccaaagtgctggaattactagtgtgagccaccgtgtccgggcccctcatttttgttcctactcttgactcttcatcacagtgtctttccttacatcttcctcagtgccttcacaatgtaaatagaaatgaaacccacaaataatagcaagacaacttttctttactcctgttctctgtgcttttatcaaaaatgtaatattttaaacaaatccatggctatttctgtgcagctgtgaccagtagggaaaactccagctgctgatgactgtgctttgtcatatatttggagtaatcccattattattaaaataatttgaaaattatttttgccccaagacacaaaagctgaaatactcttttcacaaagtattattggtaggttagtagtgatttataaatatataattaggatttatttttctcagtgtttcttcattgcttggcccctttctaaccttcattgactgaaagcagatgtttatatcaccatctctgattttgcagaattgatctgtccttacactgcatttagcattgattgtgtatggaacataaattgcttttctgatgcatatgtattccatagctctttgaatttgtgactgtgtactataacctatttaattgaaaagaatgtgctaaaatttagtcattgtccattctgctaacaaaagcagttaaaacatgctagagaaatatatcagaattttaagaaagaggccggatttggtggctcatgcctgtaatcccagtgcttttgagaggctgaggcaagaggatcacctgaggtcaggagttcaagatccggctgaccaacatggtgaaaccctgtctctactaaaagtaaaaaaagttagtcgggcatggaagcgcatgccggctactcaggaggctgaggcacgagaattgtttgaacctgggaggctgaagttacagtgagttgagatcaggccattgcactccagcctaggcaacaagagcaaaagtgtgtctcaaaaaaaaaaaaaaaaaaaaaaaaaaggctgggcacggtggctcacgcctgtaatcccaacactttgggaggctgaggtgggctgatcacgaggtcaggagattgagaccatcctggctaacatggtgaaaccccgtctgtactaaaatacaaaaaattagccaggtgtggtgctgcgtgcctgtagttccagctacttgggaggctgaggcaggggaattgcttgaacccaggaggcagaggttgcagtgcaccaagattgcgtcactgcgctccagcctggcgacagagcaaagctttttgctcaaacaactggtaaaatggagttgcagttatctaacataggaaaactgttgctacttgggaaggtgaggcaggaggatcacttgagcccaggagtttgaggctgtagggtgctatgtttgtgcctgtgaatagccactgcactccagcctgggcaacacagcaagacctcatctgttttttttttttttttttggagacagagtttccctcttgttgcccaggctggagtgcaacagcacaatctcggctcaccacaacctctgcctttctggttcacgcgatcctcctgcctcagactcccgagtatctgggaatacaggcgcatgccaccacacccagctaatttttgtattttagtagagatggggtttcgccatgttggccaggctgatctcgaactcctgacctcaggtgatccgcccaccttggcctcccaaagtgctgggattactggcattgagccattgcacccagccgacctcatctctttaaaacaaaatgagttaattcagctgggcatggtggctcacgcctgtaatcccagcactttggggaagctgaggtgggtggatcacttgagcccaggagttcgagaccagcctggccaacatggcaaaaccccatcactactaaaaatattttaaaattagccaggtgtcgtggtgcatgcctgttctcccagctgcttgggaggcggggcaggagaatgacttgaacctgggaggcggaggttgcagtgagctgagattgcgctactgtactccagcctggaaaacagagcaagactctgtctcaaaaaaaaaaaataataataattagttaattcatggaaagtacttagtaccacattctggatacaaacagatatttgtgcttggccaacatttggaggcagtaaagaaagcttatagaataaccacatattagaacttgtgaaggagaaaatatacatatatatatatgtatatatatagtctctctattaagtaatttaccataaggggtttaaataggaatgttgactccaaagtgaatcttgaaatcttggtgtttataattgtcaagcctctttttttaaaatagatttggtcaacaggaagtatttttttctaatttttattttatagacctagtcaagcttcttaattgttaaatattgttataacaatacatctgggccgggcgcggtggctcactcctgtaatcccagcactttgggaggccagggcgggtgaatcacgaggtcaggagattgagaccatcctggctaacacaaagaaaccccatctctactaaaaatacaaaaaattagctgggtgtggtggtgggcgcctgtagtcccagctactcgggaggcggagcttgcggtgagccaagatcgcgccactgcactccagcgactccgtctcaaaaaaaaaaaaaaaaaatacatctgagtcgtacatggtggctcatgcctgtaattccagcactttgggaggccaagacaggcagatggcttgagcccaggagttccaagaccagccctggcaacatggtgaaaccctgtctctacaaagaatacaaaaattagccaggtgtggtggcgtgtgcctgtggtcacagctactcgaggcttaggtgggagaatcgcttgagccggggaggcagaggttgcagtcagcagagattgtgccactgcactccagtcttggtgacagagtgagaccctgtctcaaaaaaacaacaaacaaaaaaatagatctggggccgggcgtggtggctcacgcctgtaatcccagcactttgggaggccgaggcgggcagatcacctgaggtcggaagttcgagaccagcctaaccaacgtggagaaaccccatctctactaaaactacaaaattagccgggcgtggtggcacatgcctgtaatcccagctactgaggaggttgaggcaagagaattgcttgaacccgggagttggaggttgcagtgagctaagattgcgccactgcactccagcctgggcaacaagagtgaaactccgtctcaaaaaaaaaaaaaaaaaagcatctgggaatataagtgcacccaggactctaattttatatttctatttttaacatatgagacaatactttatccataataaagtgctacatttttcagtcatataattagtagaacatatacttctctgtgattcagtttttttatttgtaaaatagagataaataatagcacttatgtcataggttgttgggagggattaaattagttctagccaggtcctatggcatgtgcccatagttctagttacttgggaggccgagtgaggcaggaggattggtttagtccaggaatttgaggctgtaatgtgctatgttcgtacctgtgaatagccgctgcagtccagcccgggcaacatagcaagaccccatctctctaaaaaattatttaattcatggaaagtacttacaacagtgcccgcagacagctgatactcaataaatgtcagctattactaaaaggaagagtttgcttctaaggcacttggctaatgtgttaaagttaaatcctctttttccaaaactgtaaatatagatttgttgtggggttttttgtttgtttgtttgtttgtttgtttgtttgttttttgagatggaatctcacttatgtcgtccaggctggggtgcagtggtgcgatctcagctcacggcaacctccacctcccaggttcaagggattctcatgcctcagcctcccaagttgctgggattacaggtgttgccaccatgcctggctaatttttttgtatttttcatagagacagggtttcaccattttggccaggctggtctcgaactcctgacctcaaatgatctgcccgtctcagcctcccaaagttctgggattacaggcatgagccactgcgcccagtgctagatttgttgttatttcttatgtagtacatatttatggtgattttcttttgaataaaaatgatttttattcttgatttttaaggaaactttagtaaaatatgtcagacataattttaattggtttttttttgcctgttacatgtgactatattggctgaaaactttttagttatgaagtttttctgtgtgctactgtcttgtattttgtatatctagtattttgattgtcaaaacactttttgaccccaaattatgattttgtcattgcaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaacagggtcttggctctttcttgacctaacccagtaatttctaagaaagcaacaacagtggcatctagtggtaatttctgttgattccaaagaagactactttaaatataggtatcacaaggtatacaaatcccccagtgtatattatggttttcaagaaatctggcttgatttacccatcctgtgagatatgaccataaagtagtgatgttgggagaaagaattttaaattacacatccaaattagttccatctttcaagctagttgttttggaaatatacagccgttttgattgtgctggtgttatatcaaacattcttaagactcctggcattttcctacaacagaaaagtaagcccttttccttgaaagtatgccttaagcttgacacatgataaacagattcactcattaaccacaagacttactgcaaatgacaaaaatgcctttaaattctgaattgacaccattaagggaaattccaaagagtaggattcatgctctgagagttaatttcaaaaaattgagcagtaacagcatggttttagtaagtatatcacttctagaaacataattggatatgctagctcggggctgcttggtgaaaaatatcttacttgatttatgcctcatttggcaatgaggagcttttcaatctataaaccattgtattatccataacacattaccccaaaacttagcagcttaaaacaataaatacgtattatcccacaggtgagtcacaaatctggaagtagctaagatcaatggttctggttcagagttcctcataaggttagagtcatcctgggctacagtcatctcaaggattgactggatgaaagatcccctttcaaacccactaatgtggtcactgactggcctcggttctttgcagcttgctagatgaaaggcagatgttccttgctagatgttggacagagacctgcttccatttcatgcccagctgggtctttccataggacagtgcacagcagggtagctggcttcccccaaggcaagtgatccaagagagcgcacacccaagttgaaagcacagtctttttttttttttttttttttttttttttgagatggagtctcgctctgttgcctagactgactggactgcagtgctgcaatctcagctcactgcaacctccccctcccgggttcaagcgattctcctgcctcagcctcccacgtagctgggattacaggtgcccatcaacatgcccggctaatttttgtatttttcatagagacggggtttcaccatgttggccaggctggtctcaaattcctgacctcaagtgattcgtccgcctcggcatcccaaagtgctgagattacaggtgtgagccaccatgcccagccaaaagcacagtcttagaactgaatcttgggctgccatattgtatgttagaatcaagtcactgggtctggtccacactcaaagggggaggaatattaagcttcatctgttgaaggcggggatgtcaaagcatttgtggacatctttctaaaccaccatggtgatattaccaaatatacgtaactgagtataagatacctttggtgttttgccgggcgcggtggctcacacctgtaatcccagcactttgggaggccgaggcaggcagatcatgaggtcaggagatcgagaccatcctggttaacggtgaaaccccgtctctactaaaaatacaaaaaattagacgggtgtggtggcgggcgcctgtagtcccagctactcgggaggctgaggcaggagaatggtgcgaacccaggaggtggagcttgcagtgagccaagatcgcaccactgcactccagcctgggcaacagggcgagactccatctcaaaaaaaaaagatacctttggtgttttaatctaaacattctttaaaggtaagatttcagtcttgcagatttgaatacatgattccccctagatagcatcaaccccttttcttgcatcaccatcatatattcatatatggcatttcagaaatgttccaaagctaaaaaatgacagtcacagggtgaaatcatggatggaaatggcagtttagtttgtttaaatatggaatattctgaaacagataagtcactgttttagtcaactcccagcttttggttagaaaatttaagcaacttagaattaaggtcgttattggcctcattcagatttcagaaatgttgaggagatgttgtagataaaaataaaaggccaggcacagtagctcatatctgtaatcccagcactttggggggctgaggcaggaggattgcttgaggccaggagctcaagaccagcctgggcaagatagcaagaccttcatctgcacaaaaatatttttcttaattagccaggcatggtggtgcacacctctaagtcccagctacttgggaggctggagtgggaagatcgcatgagccgaggattttgaggttgcagtgagctatgatcttgccaccgcactccatcctgggccaccagagcaagatattacctataaaaataaaaatggaaaatgttgaagttctattttttttttggagactaaaagtatggttatcatttagggggggaaatatccagtgtccaaaataaacatgttccctgctcacaaggaatctacagtctagctaaaaagctgaccaaaggcagtaacactgtttaagttacattagaagtactggctcttatagtacatctattctagtctgggtggtgaataaaagcttccctaaagagatgttttgagggtgggtgcggtggctcacgcctgtaatcccagcactttgggaggccgaggcgggtggatcacaaggtcaggagatcaagaccatcctggctaacatggtgaaaccccgtctctactaaaaaatacaaaaaattagctgggcgtggtggcgggcgcctgtagtcccagctacttgggaggctgaggcaagagaatggcatgcacccagcaggcggagcttgcagcgagccgagattgcaccactgcactccagcctgggcgaaagagtgaaactccgtctcaaaaataaaaaaagagatgtttgagctaagatctgaaggatggcagaccttaagctagctagagaaggtattgcaggtagctagccaatagcttggcaagtttgagaagctaagagcagctgagtatgactggaacagaaaagagggggctgcagcagtgagatgaatccagaagggcagattccacccagcagagggcagggtaagagtcacaagcagtgctggactggcctttccaaccgtgttaaataaaacatttggaccattcccaagggtgaacaggaagccattgagggcttatgaccttgatggaatcggtgcttgagaaaactcaattttgtttggggagaataagactggagtcagaaacttggtcccactgatcatacgatatagtaacacaggaagattaagggtagctttgttggcatggagacatttcaaagctataaacagtacaggaggcataattgacagttttcccaatttctcttatcagtcaggataggctggttatgttgctttgttttgtttgtttgttttttgagatggagtctcattctgttgcccagactggagtgcagtggttcaatctctcctcactgcaacgtccgcctcctgggttcaagcaactgtcgtgtctcagcctcccgagtagctgggatgacaggtgcccgctaattttttgtatttttagtagagatggggtttcatcatgttgaccaggctggtcttgaactcctaacctcaggtgatccacccgcatcggcctcccaaagtgtagggattacaggcgtgagccaccacgcctgggctggtgtgttgctttaaaacaccaaaaaaatttattggcttaaagatttatgtcttatatgctaaatactcatcaggggttgacctaggctaacaaagcagaactggaggactgccagccattgtgacagaaccaagaaagaaaacaggtaatgaaacaggcattggctttgaaaactcacctgaaattgatacacgtgacttctgttttcaatggaccaagcaattcacagccacacccaacttcagttgcgcagggaaatgcaaccctttttgcccaggagtcagaatatttgtgaattgctctgatgactacaacaggccactgtttcaattattttactttccttccttcaagaaaatacacatcatggaagaaaacctaaaagtgcctgctagtcaggcaattgagctaaaattgtgtgtggagaccaggatctacgcacccagtacacagtggtgggacagggacagaaaaattgcaggaagcacttgccttcagaaaggggaagaatgaagtcaccggtcagtaacaattatgaaatgacactggaaaccatttgagggccctctgccctaacagaggggagtgttctttgtaaggcctattaggatgggttccctgctccaccattttccatgacttttagccccatccctcatttgctgtacacattacctgtcattcctgctttcaaactggctttaaaaaaaaaaatctaactgggcgcggtggctcacacctgtaatcccagcactttaggaggctgaggcaggtggatcacctaaagacaggagttcaagaccagcctggccaacatggtgaaacctcgtctctactaaaaatacaaaaattagctgggcatggtggcacgtgcctgtaatcctagctactggggaggctgaagcaggagaatcgcttgaacctgggaggcggaggttgcagtgagccgagatctcaccactgcactccagcctgggcaacagagtgagactccgtctcaaaaaaaaaaaagaaaaaaaaataacttggcaaatgcaattaataaataaccatggtactaagattgttttccaagttcttcaagtaatgtttcaagcttgttacatttcttcccttccaagttatcacgtgacagttttaccagaaggattgacatccttccaaacgccaatgtcagttcctccaatcaccgtccttccagctacccaagctgggaaaactatgtcgttattcttgactcccagtctctctcatctcccacatgcaatctgtaaatcctgccagtggattccatcaattctgttactattagatgttttaaaattttagttatacacaaagcaattacctgtaagccagacacacaagtacagacctcctaacaaatctgtgagattgttacagattttacagaagaaactaaggcatggagaggctaattaacttgtcaaggcacaaagctattaagtggcagaactgggattcaaattttgagtccctgagcttaatcaccatgttctgacctgaagctgtccctgcatgtctggctttgactgctaccatgactacttgccctccctgaatatgcttttcattagccaattccatatttctgaacatccctaccctcagtttgggggaatggctgtagctgacattctcctgagttggcctgctcctgccaggcaccttctgcttctattgtgtgtgtgtgtattgggctctgggccaaggcctcctaatatcaccatcccaaagctgttattcccaccttggataaaaacctgggtgaatcaacattaaatgagcaaagataaacttctgtttatttttttagagatacagtctcattcttttgttgcctaggctgtactggagtgcagtacatagctcactgcagcctcaaactcccaagctcggccgggcgcggtggctcacgcctgtaatcccaacactttgggaggccgaggcgggcagatcacaaggtcaggagatcaagaccatcctggctaacactgtgaagccccgtctctactaaaaatacaaaaaattagccgggcgtggtggcgggcccctgtagtcccagctactcgagaggctgaggcaggagaatggcgtgaatccgagaggcggagcttgcagtgagccaagatggcgccacggcgccactgcaccccagcctgggcgagagtgcgagactccgtctcaaaaacaaaaacaaaaagcaacaacaacaacaacaacaaaactcccaggcttaagtggtcttcccacctgagcctcctgggtagctgggactacctgcatgtgccaccacatctggcgtgtgtgtgtgtgtgtgtgtgtgtgtgtgtgtgtgtgtgtgtgtgtacggggtcttgctatattgcccaggctggtctcaagctcctggcctcaagcaatcctcccacttcagcctcccaaagtgctgagattataggcatgagttaccacacctggccagataaacttttgttgttgactaacattgttcacagaaatctgcctactattccaacagggaatttcttagggcgctccccgacaactttgttctttctgtttgggggttacccaaattagaaatccttttcactttgttatccagaatgatgtggtttcttctttgtcttgcctctggtacaaccccactgggcttatcccacaaccccactgggcttatcccaccccaatttaggccccacccatctttctcctccagaaataagtcccctccaagttttgagagagtcttgctctgttgcccaggctggcatgcagtggggtgataattggctcactgcaacctctacctcctggattcaagtgattctcgtgcctcagcctcccaagtagctgggactgcaggcatgcaccaccacacctagctattttttctatttttagtagagacgggttttcaccatgttggccagggtggtttcaaactcctgacctcaggtgatctgtctgcctcggcctcccaaagtgctgggattacaggcgtgagccaccgcgcccagccagacacttttaattgactaagattgctcctcaccaatcttaagatttttccccagatttccttcccaagctatctagcccagctgcccaactaggcttttctaaacatatctttaatgcttgtcatgataaggaataatgaccccctgattcctgtcctctgccactctattaggtatgattgacaatgttttatttttccagaaatgttctttctttttggtacagccactgtttcttttatttttgtttttacagaaaaaaaggccgggggaggggggtggtgggtggtcatggtatgcatacttctgcacctggcttttttctcttggagttccttccacatcaacatagagacctacttcactttttattatttatttatttatttagagacaggatcttgctctgtcatccaggctggagccccggggctcaataatcacagctcactgcagctatcctcaagctatcctcccacctctcagcctcttgagtagctaggactcctggcccaacctactgccatgacaccagctaatttttttttttaatagagactgggtcttgctatgttgcccaggctggtctcaactcccgggctcaaccgatcctcccacctcatcctcccaaagtgctggtattaccgctgtgagcactgctctcagcattcacctttaaaaacatatctctatctatctatctatctatctatctatctatctatctatctatcatctatctatctatctatctatatcacggtttatttagccacttccctactggacatctcagtgacccagttctgttgttttggcatacaatgctgcagtggacaaccttctccatgtagttcattttaatcaaacagcgacttcaaattttgatagagcctccaaagaaacgctagtatcaagccagtttgagaatttagtatgccactctctcccctactgaaaaccttcttccaggggcaatgtaatggaaaggacttgggttctgcgcctagaaccaaggagccttgggtctttaacatctctgggcctcatgtattcgcctatgtaaagtcggtataatctcgcatctcaggttggttgtgagaacccagagactgcctccgtgaaggcttggcatcagcataggcctcggctgtcctttagtttcagggtgtcccggggcacgggccaaaacctcaggctgaacctgctagaggaaccttcctgtcccttgcagattaggaaaactgtggcacagaaagcgccaaggggttgatcaagacccccacagctttggtccacgctgctgccggcggcttcggatcctggtcccgggggactgcgcacatttggatgtggtcagcagggaggcctggcctggccccttcctcttctacccagtcctctccccgaaccaattccgacccctaacgcccacagtcctcactcgcttacggttcgacccttgccccaggggcgactgggtggggccgtcattcctgaacaactaaaagctgctgcggccagcgtcacctccggccccaacggagacggtgggggccgtgaggcttagggactccgcgtcctccctcctgctgggcctcagcgtgccctctgtacttgccttctgctaccagtgaacgtgagtgggacgtgtgtgtagacagcagacgggtcttgtgcagctgtgtgacgtgtgtgttgtgtggtgaacccttctttatgtagatatgtgaagtgtgtgtgctgtggtgcacagatgtaggggctcacgaagtactgggctccttgctcctagagcccgaacagttcccaacgttacagccctgcccgactcagcctccgcagagacggcggcgggacccgcagtttgcgcgtgcgcggctccgccccaggctcctccctcgcgctggcactcccgccttcgcccggccctccccgcgctttacggcccggcacgccacttttactgcagtcgcgcccgccgccgtcgttgcccccgctgccgcggctgctgcaggtgaggtgaagtgaggtgaggtgtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggtgagtttggggtcctctgtcaggaccccattcgctgatccttgctttctcctgggctcttcccacctgttctcagtctctcacgcccctgcgcccgcagctcctcacctctttcgtcctctcggctcgctgggctccaggcactagatacccgctccaactggcccgatttgcctgtcagttgctcgtctcgggtctcagcagggtctcttctgggacggtggaacagtagtagtaaagacaataatagcttgctctccccaaatgcctaatgcccggccctgctctttttggacgtaattctctctagtacccctcgccggcacctgaggataggtactgttgttattcccatttccattttacagactaaataatggctgagaagtggctgacccctctgatcatcactgtggcctgtggtctgtctcccactgcttttctgggctgtggcttccttcccctttttaggaggggaaacctaggcttggaacccatgatcagatgttggggctctggtcaagggagttgagtttgtgtgtattaaaggaacagctgacttgcttctctcttttttttctttttttttgagacgaagtctcgctctgtcgcccaggctggagtgctgttgcgtgatcttggctcactgcaacttaacgcctcgtgggtttaagcgattctcctgcctcagcctccccagtagctaggattacaggcacgcgccaccacacccggctaatttttgtatttttagtagagacgaggtttcaccatgttgaccaggctggctggtttcgaattcctgacctcgtgatccgcccacctcggcctcccaaagtgctgggattacaggcgtgagccactgcacccggccccgcttctctctcttttgaaatatagtctgtatcggatgctgtaatcctaaacccagacctcagttgtgacaggtgaaggttggatgaaataggagttagggagaagtaacatttagtttctaaaaaatgcagtttggtcgttttggggtttgctggcccagccttctcccttcaccctctccatttccagcatcactacttttatgtgtacaaggatgtttgcattcagtaacccctgtgtgtttactttgatgtcccagcactaagaaaagggggtggggtaggtgttggtgctgtttgtttgtgcaggcctgaactttagtcactctagtgtgagctactggactaaatcagctgctccattggattataaattatccttgactctggaagacttatgtctgtggagacagtgtgttggagaaaccaggtggtacagattgctggtaaggccctgctgatgcttagtggctacatatgtcctgtgtgttgtaagagctagtttttgttgttggtgttttgttttaagacagagtcactctgttgcccaggttggagtgcagtggcacaatatcggctcactgcaacctctgcctcccgggttcaagcaattctcttgcctcagcctccctactagtagctgggattacaggcgtctgccaccacacccggctaatttttgtatttttagtagagattgggtttcgccatgttggctaggctggtctcgaactcctgacttcaagtgatccgccttggcctcccaaagtgctaggattacaggtgtgagccaccatgcccaaccataaaagccggtttaatttaggggagttggccaaattctttcataacttaacaccactcctgcagagttctttccaaaatattagctggtacaaaatgctccattctctcgtgaagcactaagagcttggttggaaggctggtgataccatgctaatgctgtttggcttctggttaactcctttcctcccctctccttgacagcttctacccaagcaagatcctcccacggctggataaaaaccacaaccatagcttcaaactgtgcttagtagtgtgactaggttgtggatctcttggtggtacaagtattcagagtcccttggtcaaaagcagtggtagggactgggtgcagtaactcatggctgtaatcccaacactttgggaagctgagacaggaggatagcttgaagccaggagttcaagaccagcctaggcaacatagtgagacctcgtttctaccaaaaaaaaaaaaaaaaaaaaaagccaggcctgtagtcttaactactcgggaggctgagatggaaggatcacttgaggctgggaggtcaaggctgccgtgggtcatgatcacaccactgggcgtgatcctgggtgacagagagagaccctgtctcaaggagacaaaaaaaaaaagtagttactaggatattaattgagatgaggatttccagaaaactgagtgagagagcaaggcttctctcagctgttgttttgataccctaaccctgactcctagctctgctagtttcccaggaatcaagggtttacacagttcttacaaactgtctaaatagcaaccaaaaacagtgagaagggcatttctgtatattgggtcaagaattgaattttagggggaagctcatagactggcccagaggcttcatgattcccttgggtcttaaaattcatttttacatggtgtctgcctgagagatggtgttaatttaactttatcagactttaaaaatggaaagtcattttccacctctgtcaatctcctcccccaccctgaacacgtccaaactacatttggggctgttaggtagggataggtctcggaagggaatctgctttagaattacatgcctaggctagtgaaccaggaagaacttacctcttgccaccacaggcttgtaagataggtgttgttatctctttttgccaggtgagggacaggctcagagagagagatgataaacaaaagtcgccaaacaggcatatcctgcatgccactgctctttccttctgaaagtggactcaactttgtcaccaggtttcttattggaatctgtgcaaatgcagatgcaattatctgcctggcatcacaatgggaagctgcatcctggcagctccttggctgccttcctggttgtataatgttggatgattagggaaatgcgagcaacacagggaaaggaaaacctaggccaagcagaatctctgtgaatatgaatgtcactgatgatttgaccagcagtggagtaaaggcagtgcagatttgaaatgttttgttttctttttttctttttcttttttttttttttttgagacggtgtctcactctgttgcccaggctagagtgcagtagcgtgattttggctcactgcaagctccacctcccaggttcatgccattcttctgcctcagcctcccaagtagctgggactacaggcgcccgccaccacgcccagctaattttttgtatttttagcagagacagggtttcaccgtgttagccaggatggtcttgatctcctgacgtcgtgatccgcccacctcggcctcccaaagtgctgggattacaggcgtgagccaccgcacccagcctcttttttttttttttttgagacagagtcttactctgtcgcccaggctggagtgcagtggcgtgatcttggctcactgcaacttctgcctcttgcgattataggcttgcgcacaccaggtaattttttacttttagtagagatggggtttcacgatgttgaccaggctggtctcgaactcctgacttcaagtgatcctcccgtctcggctcccaaagtgctgggaggcatgagcatttgtgccgggccctgaaatgttttcaatgagagttgcagaatgtattgatgcagaggcaagtctctgaatttgtttttgaaattagtcttgaaagggactaaaaaaggtagatttaaagggtcagtgaagaaaataccttctccgagattaccttgttccacagagactgaaggctcactgtgttgaaggcatcatctacctctgtgaactctgctcacaaacattgaaaataaacagtgcacagtgactcatgcttgtactttgggaggctgaggtgaggggatcacttgagccaagagtttgagaccagcctaggtaacatagtgagaccctgtctctatttaaataaaaaataaataaataaaaatttaaaaaaaaagaaatgatcttattccctgaagagcttagtctagtgatagagagggattatagaaatagttccttttattataatcaagtagaagatgtatagggtactgtggaggggaagaagaagggacttgacctgacctaggggttcagagaaggcttcctgccaaacaacaggagctggaaatcttccagtcgaatgaaagaagaaaaaaaaaaaaaaccacaggagaaaaggtagatgatgtgtgcagggaactataagcaatttggtattataattagagcatgatgtactggtagaagaagaaaatggatttcccagagtcccaattctgtttggttatagctgcctgggatactatcaaggatactttgtgttggaatctgtgcaaatctgtggaaaaaaggatatgtattagtgaagtgtattgtgggctttcgtttaggaagaactggatttggagaggtggggaagaaggaggaatctagaggtttctgacttgagaaactctgtatgatgttggacatagatattgagacctagaatacagagaagatgaaaagatcacttttaatctgttggcttttatttgcctttagatgtatacagaaaacagatggagatatgagtcagaaactgggtggttagttgaaccagggatgagcagaagaaacatagcctattggagagacttggaaaagttagaggagagtagtattggtggagagacaataggagttcaagagaaggagggtggtcaacaggattcgtggtataggacctaagtgttctacctaattgctttgtttcacagatgtgcatgaccacctacagctgtgccaggcacagtgattgggtgctgggaggtattgaggtgaacaagacagacaaggtcctacctctgtgaggatataagggagactaacagataaataaatggtatgagaggcttcattgaataaggcagtgagggaagtgaggtgtgaccaagacctaaagtgcgaacaagaggcagctttgggtagagcattccagattccagcagcaacaagagctaattcagaagcctgaggtgagaaggagcttgacgtgtgcaagtaacaaagggtgaacagtggaaagaagatatagatgggtaagatccagaatattcagggcctttggtgatgacatggtgtttgggttttatctgcctgcaatgggaagccattgagaggttataagcaggcaagtgctgagatctgtgagacaaagatttgtgcggtttagaaggctgaccattctgttagagctgggatagtgctcctgtttctttgccattcatatagttagttccctttagagatctttcgtagccctcctttaccagtagctgtgtgatgaccagtcaccatggctgcttcgtctcctctgggtgagtttctccctgggtgactcaggatcctaagatcctaagatgctgagacatcctttgatgtggtaaatggaatcctccctcaagaaactggcatgggctgggagcggtggctcatgtctataatcccagcattttgggaggccgagacgggaggatagcttgagctcaggagtttgaggccagcctgggtggcatagcaagaccccgtctctttgaaaaaaagaaaaagaaactggcatgtgccacgtggatcagagaagccatgcggccttcctctttcttgacatctaactaactgagtttctctgtcttctgcacgtggatgtttgtccattcctcctgggaatgacagcatagatgttcctccatttaggaatggcaaaggtgagggatgcatccagcttgttcatattctcaaacatttattgagtccctactgtgggccaggttttatgctatggaaggctgaaaagtgcttttttaaagattataagtcagccttgtgatgattgccttcaactttcttcagactgaagaatggcctctcagatgagggtagaatcagattgtttaaatgtagatgagccatgagctttttaccttctaattaattcttcatttgtcagctcttttttgcatatcgcatctctttgacctggaggccaactgatttaaatgtgaactgactgccatcggatgaagccatggtcccttttccttcctttctcttgtcacccactctacaatccatcagtcccactcagtaaatatttattcaatagtcactgtattggccacgtgcggtggctcacacctgtaattctagcactttagaaagcggaggtgggaggattacatgagcccaggagttcaagaccagtctgggcaacacagtgagacctagtctctaccaaaaatttaaaagttagccagttgtggtggcacatgcctgtagtcccagctactcaggagactgaggtgggagtatctcttgagcctgggagacagaggtttcagtgagccaagattgcaccactacactccagcctgggtgacacagtgagattgtgtctcaaaaaaacaaaacaaaaccagtcactgggtggttagctctgagcagggtacaagggatccagagagtggtgaacagcagatacattgtttttgtattcattaaactatgagtctttgttttttgattgcccaggacctgtctctatgtgtgtttcttcttgtttaaattataatggactctggaaacaaacttttttttttgagacggagtgtcactctgtcgccaaagttggagcgcagtggcacgatctcagctcactgcaacttctgcctgccaggtttaagcaattctcctgactcagcttcctgagtagctgggactacaggcacacaccaccatgcccagctaatttttttttttttttttttttttgtatttttagtggagacagggtttcaccaagccggccaggctggtctcaaactcctgacctcgtgatccgcctgcctcggcctcccaaagtgctgggattacaggtgtgagccaccgcgcccagcctggaaacaaactttttggtggtctcagtgagtccttagactgttggagatgtcattggaatttggattacttaaactggaggcatatgtaaatctgcttataatgggccatgagttaaagaaccaagtgttaagagttagatattcaggccgggcacagtggctcatgcctgtaatcccagcactttgggaggccgaggcggtggatcacgaggtcaggagatcgagaccatcctggcttacatggtgaaaccctgtctctactaaaaaatacaaaaaattagccaggcgtggtggcgggagcctgtggtctgaggcaggagaatggcgtgaacccaggaggcggagcttgcagtgagcggaaatcgcaccattgcactccagcctggacaacagagcgagacttcagactgcgtctcaaaaaaaaaaaaagagatattcaggaatgcctcgccctgttgctttttttttttttttcctcctgagacagcacctggctctgtcacccaggccagagtgcagcctccacctcccaagctcaagccatcctttcacctcagcctcctgagtagctgggatgacaggggcacaccatcatgcctggctgatttttttttttttttttgagatagagtctcgctctgtagcccgggctggagtgcagtggcgcaatcttggctccctgcaagctccacctcccaggttcatgccattctcctgtctcagcctcccaagtaactatgggactacaggcgcccgccaccacgcccggctaattttttttttttttttttttttttcttttttagtagagatgggctttcaccatgttagccaggatggtctcgatctcctgacctcgtgatctgccctcctcggcctcccaaagtgctgggattacggacgtgagccactgcacctggctgcctagctaatttttttgtattttaataggcatgagccaccgtaccctgcccctgttgctttttttttttttttttttttttgagacagagtcttgctctgtctcccaggctggagtgcagtggcgctatctcggttcactacaacctctgcctcctgagttcaagcagttctcctgcctcagcctccagagtagctgggactacaggtgtgtgccaccatgcctggctaatttttgcatttttaatggagacagggtttcaccacgttggctaggttggtcttgaacttctaacctgatgatctgcccatctcggcctcccaaagtgctgggattacaggtgtgagccaccgggcctggccccttgtcgctatttttaaattaaataaaaaataaaaagaactagatatttgtgggattttaagtaaaaatccagtgaaatccttggtaaaataagttgattcattgattctggtggatgagtgatcttaaacttttttttttttttttttttttttttgagatagggtcttgtctgtcacccaggcgggagcacagtagcacttatcatggctcactgcaggatcaacctcctgggccgaagcaatcctctcaccttagccaccccaggacctagagtagtcccggcatatcccaccatgcccagctaatttttttactttttgtagagacaggatcttactatattcccaggctggtcttaaattcctggcctcaggcgatcctcctgccctgccctcccaaagtgttgggattacaggcatgagccaccacacccagtcctgattttaaacttttaaaattgttccttataagtcatgtactctaataggccttcatttcagagatgcagagacaggtgccagaaaggaagagaaaggacctatctcaggtcatatctaagccatggcagagtgaggaccaaaacctgggtctgcagaattatgcagtcagtgcttttcttgcttggttctttgattcatacttactttgctttctctgagcgcttgtctgtgtcagatcagtgtggaggtccctgtttccaggaagactttttgtatattcactgcctcccatccccttccatgcatgtccaaccttttggcttccctgggccacattggaagaagaattgtcttgagccacacataaaatagactaacactaatgatagttaatgagcttaaaaaaaataaaaatgtaaaaagggtccatgcatcatacgcatcttttttttttttttttatagacagagttttgctctgttgcccaggccgagtgcagtggcgtgatcttggctcactgcaacctccgcctcctgggttcaagcatttctcctgcctcagcctcccgggtagctgggactacaagggcagccacctcgcctggctaatttttttttttttttttttttagtagagtcagagttttaccatgttagctaggctggtttcaaatgcctgacctcaagtgatcctcccaccttggcctccgaaagtgctgggattgcaggcataagccaccacgcccggcccatgcatgatttttgtgatatccaccaccacagataagcaaaagagtccttgcattcaaagagttggacacctgtgcaccgtccaagtattctcttagtgcttgctgcttaacattattgtagctcttactgcttattgaactcttatttactcatgtatctgtagaccttagtagcccccaaacatccccaggctttactgcagggaccagtgcctagtgaagtggtagatgtcaatagatggatagccaaaataaccacataggtgtcttgctttatttcaggaatgcctctggctcaggcagtagccattcttcagaagcactgtcgcatcatcaaaaacgtccaggttctctacagtgaacaggtgagtggtggctgatttgtttattgaaatagcatccctcggtagtgagtcacttccagagctgatgctttgggataggctgactggcaaggatagctgtgttcgaatgggagaatctctagcaccagccagttatcaagtaccttttctttgattctgaaacttctgctcttgattatctagtacagctaggtttggaagagcggtagtaattgaacctttgttttgtctgtgctcaacttgcctacaggcccttaaacagggacttttcagtggtaggtcgcttcagaggctgtctctggtcttttagagtgcttaccttccacttccgtgtttaaaattgtcttttctgcttttgttggttagtttgtgttcaggatttttgcagtgcagatctctagctagcacggcataccagatttgaaaggaaacagatataattcacccctttatctctctcaaagagcaatcttcccaccactgaattctctgaaacctgcagttctgtgacacagaccatgtgctgccatgttgaacagcctttgtggtgtcctgtgtgtcacaagcctcagggaatagttttgagcctacagaggctaaaggatgtccccagtgacttttctgagaccctttgagtactagtttgattatttcagttccaattagtttcagatcctaaagcaaatgacagcttatttctgacatgaagaatgttgtaaattgtaggtaggcaaaatttctgagaggcttctcagtttgacttggagcacagtcagaattgggcctgttacctatacccagagattacattctgccatgttgtacccctctaccagcctagtgagaccctcatttgagggatctgatagaagacatgcttaatctccaagcaagtgcttgagtattcatgtggtgcctatgacagaacaggagacttgtaggagtgggcatgtggtgcctatgacagaacaggggacttgtaggagtgggcaggggtttctttttttttttttgagatggagtctcgctctgtcgcctaggctagagtgcagtggcacaatctcggctcactgcaggctccgcctcctgggttcacccgccattctcctgcctcagcctcccgagtagctgggactacaggcgcccaccaccacacccagctaatttttttttttttttttgtatttttagtagagacaggttttcaccccattagccaggatggtctcgatctcctgacctcgtgatctgcccgcctcgacctcccagagtgctgggattacaagcgtgagccaccgtgcctggccaagagtgggcaggggtttcttaaaccaccatggattatcagtgccaaagtggattctcgttaattaaattaatttatttactttttttttttttttgagacagagttttgctgttgttgcgcaaactggagtgcaatggtgcaatctcggctcacctcaacctgcgcctcccgagttcaagcgattctcctgcctcagcctcccgagtagctggggttacaggcatgtaccaccactcccagctaattttgtatttttagtagagacagggtttctccgtgttggtcaggctggtctcgaactcctgacctcaggtgatccaccggcctcggcctcccaaagtactgggattacagacgtgagccaccaggcttggcctatttaacttttaagaaaatttattttagtttttttgagacagtatcttgctttgtcatccagactagagtgtagtgacatgatcacaactcactgcagcctcaatcccctaggctcaagtgatcctcccacctcagtctcctgagtagctgggaccacaggttcatgccaccaggcctggctaatttatttttatattttgtagagatggggtctcactgtgtttttcaggctggtctcaaactcctggactcaagtgatcctcccacctcagcctcccaaagtgctgggattacaggcgtgagccaccgtgaccggccaaaatgtatttcttatatcaccatcatcattgtctgttattccagtatttgggtataaacagtgttagcattaagctgattttccccaatatcttctgagcaactttaacacattagcaaatatgggtttgaccaggcactgtggctcacaccactaaccccaacacttcgggagggccgaggcaggaagattgcttgagtccaagagttcgagaccagccagggcaacataaaataaaaaattaacctggagtggtggcacacacctgtaatcctggctattcaggaggctgaggtgggaggatcatgagcagtgaggtatgattgtatcactgcacttcagcctaggtgacagagcaagaccctgtctcaaaaaaaaaaaaaaaaaaaatgggtttttgagtctgaatcctgatttagatctctgcttttctcatttctaattcatgagagttgtggcatattaataagtaatctggttatctttatgtaaaacagtatagtttcttgataatagaataatctttgggtttgtttatttgtttctgagacagagtcttgctccgtcacccaggctggggtacagtggcacgatcttggctcactgcaacttccacctcccaggctcaaccgattctcctgcctcagcctcccaagtacctgcgattacaggcacatgccaccatgcctggctaatttttgtatttttagcagagatggggtttcaccatgttggccaggctgatctcaaactcctgacctcaagtgatccgcccgtcttgtcctcccaaagtgctcggattacaagcatgagccaccacacccagcctaggataatctttggatgaggatcaaaaggagatggtctctcagaactctgatctgatgcttttttttttttttttgaagcagcatcttgctctgtcaccaattctggagtgcagtggcatgatcatggctcactggaacctcccctacccttcctcctttagttttgccactcctgggctccagccgtcctcccacctcagcctcctgggtagctgggaccacaggtgtatgccaccacatctggctattaaaaaaaaaaaatttggccaggtgcagtggctcatgcctttaatcccagcagtttaggaggccgagacgggcagatcacttcaggtcaggagttcgagaccagcctggccaacatggtgaaaccccgtctttactaaaagtacaaaaattagccaggtgtggtggtgcatacctgtaatcccagctactggggaggctggagcaggagaatcacttgaacctgagaggcggaggttgcagtgagccaagatcgtgccactgcgctcctaggcaacagagtgagactccatctcaaaaaaaatttttttgtagagacagggtctcattatatttgcccagactggtctcaaactcctggctttaagcattccgcctgccacgacctcccaaagtgctggcatgaaccaccgcacccagccaatgtgatgcttcttaaatttgggtcctgtcctcttcttctgcctactttattcccttccttacccatttgtctctttgtttcccaaatgcagaaaacattttgtctgcattaaacatttcagaaatatgttcttgtctctatgcaaatcacaccttggaaatgaaatgtcaagtacgtcccatctttcttagagggaaaagatattaacaactagtagcagatgattttactgaactgcttcatgtgaaggacagctaggttactggaagaacctgcttaaataccacatagtgcatgtgtattttggttttagagatataaagtattaataaaacattgactctgagagtaatttgattgcttttgaaaattgctaggttatatcctgaattataacaatgccaggaaaaaaaaaaaagatcagatcttgggaaagtataggaaaatccagatcctggcacatgcctcctccaagcaagattcctgaaagagactaaaatgttgcttcactctgcttattccatggaatggctctctccaaaatggaactttgtgttctgggttgatactggtaatccaaggtcatagttcattgttccattatcttgcttgagacctaatggtttagacattcatatagacctactagcaaatacaacattcttcctttagtttttgccaagcatgatggtactatctgggcctgctgctttgtggggatcaatgggttggaaggaagcaacctgccctaatcccaaaagactcttaggagagaatttctccaatgaggccaacaccagcagtggcttatggccttccagcctatgtctgtctctgatagccatatctccatcattcactttgtctaacttgagaagctctataaagaaactaaacctttggccgagcacagtggctcacgcctgtaatcccaccactttgggaggctgaggcagatggatcacgaggtcaggagatggatcacgaggtcaggagatcaagaccatcctggctaacacggtgaaaccccatctgtactaaaaatacaaaaagtcagccgggcgtggtggcgggcgcctgtagtcccagctactcgggaggctgaggcaggagaatggtgtgaacccaggaggtggaggttgcagtgagccaagattgtgccaccgcactccagcctgggcaacagagagagacttcatccaaaaaaaaaaaaaaaaagtaactaaaccttttgagcagccatgtgttaaagaagggtggggttttagatggtgtttttccttctactattgggcagcctcaatcagggctgtggagaatcttcagacattgaatccttgaattaattgcattggaccagaagcatgcagatggggcagacacaagaggagagtgctgtgtgccaggtattgggctagatgctttctgacctactatctctgtcctcataacaaccctggagggaagggatgaaagtattcccatgaagaaaccagagctcagagaagttttgagagttacctaaggtcaccagggttctgtccactgctttgttctgctactcccctcccccaggattcagaaggggcaaatgcagaaatatgactctttagatcttagacttcggcttttcaggaagaagcacaaatgaaatgggatgggaggctggggggagagagaaaaaggataagagggtcatctcataatcagatcacaatatatttctttgtcctagaatttgatctaaaccatcaaagaataaaaatgtgttccctgtggatggtacaaacagcctgagtgtgaatggatgtaggttcagctgataggcataagcaatatctgctgagtttagatcctggactaggccttttcacatgacctgtattcctcaccaactgctctgtaggttcgatggcagtgaacttcattttgcagatgtggaccctggagcctgaaaggagaatgacctgtatactcatataactttgtcccttttccccaggtatttttactcaagcccagaagggagaggctcttttcagccgatattaagaaacagcagctgcaggctagaagtaaaaaacaccatatgttcatgcagcagtttttttctggtttccaagcaccattagctggaggagagagggactgtctgcacttagatattccttgtgtgttgcatttgtattgtaaggctttcagtaggtgcttagtgaataaatcagttactcagaatgtattttatttttgttttgtagtctcctctaagccatgacctcattcttaacctgactcaggacgggatcaaactaatgtttgatgctttcaatcagagacttaaggtaactataaatgacaactaatgtttcatgtccagctgggccagtctttctggagctaattagtatgtgctattgtgagatgtttcaaaacttataagtaggtgtggacttctttggttcagagatcactacaatgtagggaactgaagctgtgcctgttcccctaaaaagagggaagatggaagtgggttgggatggtcagaaagaggctgggaagggctgctttcccaggctccagaggggaaggtgaaagagtgttgaagatttgggaaacatgctgtggggagggggctttcatgtccagtaggaaaacaagatagttttacttcattcttttgtcaaacactgtaacttggttagaaaatggaaactgttcttcctagaatgctggggcttgggttaacaataccagcaatgagttgattctttaaccctggggaggaaatgtaaaaaaacaacttactaatatgtagggctatcttaattggcatttgagtgcaatttgctaacacctgtttgagtccagtctggttttctttgtttttgtttttggtttttttttttttttttgagatgaggtctagctctgtcacccaggctggagtgcagtggcttgatcttggctcactgccacctcctgggttcaagcgattcttctgcctcagcctcctgagtagctgggactacaggtgcacgccaccacgcccagctaaatttttgtatttttagtagagatggggttttaccatgttgaccaggctgttttcgaactcctgaccttgtgatccgcccaccacagcctcccaaagtgctgggattacaggcgtgagccaccatgaccagcccagtcttttttttttttttgagacagagtctcactgtgtcacccaggctggcgtgaagtggtgcaatcttggctcactgcaacctctgcctcccgggtttaagcaattctcctgcctcagcctcctcagtagctgggactacaggtgcgtgccactacgcccagctaattttttgtttcaccatgttggccaggctggtcttgatctcttgacctcgtgatccgcccgcctcggcctcccaaagtgctgggattacaggcatgagccaccgcacccagttcagtctgtttttgatataccctgtttacaaatgcctgggcctcacaggttagtcatgtgacaccagagtcatgcctcaaagtcatgaggttggatgggccctgggcagtggcatgccagagttgttgtccttcttgggttatggagtagcctttccaaaagacttgggtacttaccagttctcatcatccttgtcacaagtgaactgctaaggagagaaaacaaaacatggaaagagaatcagtatgtggaattagaattcctcattctatcctgtctccatggccagaagttccacactgggaaagggcagaggatgatcttcaatatcgcataatcacaaattggagccgggtgcagtggctcacgcctgtaatcccagcactttgggaggctgaggcgggtggatcacgaggtcaggagatcgagaccatcctggctaacacggtgaaaccccgtctctactaaaaatacaaaaaattagctgggcatggtggcaggcgcctgtagtcccagctacttgggaggctgaggcaggagaatggcgtgaacccgggaggcagagtttgcagtgagctgagatcgcaccactgcactccagcctgggcaacagagcaagactccgtctcaaaaaaaaaaaattggggggaaattaatctggtaacatggaaatttctttacaagtagtcatttccctttgacttggtaaaagtccactttagaaaatgtaacccagaaacactgggggaaggtaacggtatttcatggtaatgagaagctggaagtaacctaaatgggcaacaaaagggatgtccagcagcccataaaatcacagcatggtgaagacaatgtcatatgtttagtgagtgcttagtatatgctaggcacatggctgggtgtttcacatgcgttttctagtttaatcctaacccgcctgtgaagtaggtactgtttactagcaagaaaaccgagggacagagaggataagtagtctacctgatgccaggcttttaactggatattggcaatatgtggtggctgaccacttaggctctgttgatggatctgggaaataaataagaaaagctgaagaaatgtacagaaatatgaggaatgggaggtacctttggataggaaaggagataaaatcaaaccggcaatcctcttctgccttctgtgggatccccatgaaggagagactggggtcctgcctgagtcttctggaaactgagcaagtaatcacccaggtgtttttgattggcaccagcctgacctgacctatcttcctgcccttccatccaacaccttcagaatccacctcttctgatgctgcctcctatagttgcttcccaccccctgcctcaagcctaagagagacagccctgtggaatgaggctttataagtcacaacctttacagccacctgtcttttccatttttatcttggctgctgccacatctcttcccctctggggaaatcaggagcttctgtagcccagagatggaaaatcatgggctttagccttcccagctgcttgtccctgtagtgcagcaagctccaagagatgaaatctgcttattgatgctcctagtgacatgaaggactccaggatggccagcactctgggtccattgccacaagtgctgcttcgtgccctgtgattagctctggtccactgttttcccattgatcaggcagggtcgaagcacctatatgtgttggacccgtatagctgttggcaggtggggtgccagtgatacaggaggaacatcgtgcaggctcacttccacagggcgggtggtgggaagctttgggggatgactggccagctgtagggatagaagtgagggaggtgagtgcctgtgcctgctatgaacaggagggcttctggctgaaggtagaggctctctgctagacaaggctctggcctcagtgaaatggcatgccagtttggcatgatatattcccatgcccagatattctgaaggggacactggctatcttctgaatcatagctgttcccctgcccttccttccacagcccctcctggcacttcttttcatgctttcaagcttcataccaggcagaattgcctaacatgaattgaacaccttccctatgcaaattaatgagtccctcaaggggcttaacttattggaccacttaacagaatacacaagtatggaggaaaggattcattccagtgctgtgacggcctagcagagggagcagttctttctagcagataggatcaaaagagctacattatagtcaagaggtatccaatttggttcagtgttgtggtctctaaataaagttagggatagggtctctggccaaaagcgaacctactatctattatgtctcagtttctttggcagtgccagatgttcctgcatacaatgccccacagcctcttccacaatcaggctcagattggcaggacaaacagatattgagccagctctgcttgtgtctccacaatgagagcaaaacctcccagctggaggatggtagatggtgctccgagcccctacctgtgctgctggctgccaagcccttgacaccattgcatggaggacttcatagtgcttattacttggcaccactgatggcggagtgttaggtgatgcctattcctttatctctgccctgccctgagttcttagaatttcatctgaggctgaacccattaaagagcaagcttcacaaaggtcctgaggctttcttgtttcaaccagatcctcttcatcagggacataactgaatactgtcacacttgtgtgacaaatattatggcttgctttctaatgggatagacctccccctccatctttttgttttgtaaacaaaatcaacttcaaaataagctattttctttctttctttctttcttttggaggagtctcgctctgtcgcccaggctggggtgcagtggcgcaatctccgctcactgcaagctctgcctcccgggttcacgccattctcctgcctcagcctcctcagtagctgggactacaggcgcccaccaccacgcctggctaattttttgtatttttcagtagagacacggtttcaccgtgttagccaggatggtctcaatctcctgaccttgtgatccgcccgcctcggcctcccaaagtgctgggattataggcgtgagccaccgtgcccggccttttttttttttttttttttgagacggagtctcgctctgtcacccaggctggagtgcagtggcgcaatctcagctcactgctacctccaactcctgggttcaagcggttctcctgcctcagcctccacagtagctgggattacaggtgtgtgccaccacgcccagctaatttttgtatttttggtagagacaggatttcaccatgttggtcaggctggtctggaactcctgacctcaggagatccacctacctgggcctcccaaagtgctgggattataggcgtgagccaccgtgcccggctaaaataagctattttctaaagcaacccgacctgggttttaaaatgcagcaaaatatgagatgggaggaagggggcttagtgcccaaagcagagccttaacaagcttcatgtctgtggaagagatcattgtcctatagggtggtgtgtgctccagcctgacccagaagtggactgcatgtaagagccttgacccagagcatccatggacatctgttgagcagtccactaggagagggaagctaagaggttatgctgaaggggacactggctatggttatgctgaaggggaaactggttttttccctggtttcaaaataacaaaggactgtcatggtggctcatgcttgtaatcccagcactttgggaggctaagacaggaggatcatttgagcccaggagtttgagaccagcctgggcaacatagttttttagttttgctaagattctatctctacaaaaagtttttaaaaaaattttaaatgagaacaaaagataacatgcagtgcttccataaaatttctattggtaatagttttttttttttttttttttactatttattctataaatgtatttttaatcatttttagtctgtcatcactttcagagcattgacaactcttaaacttttttttaggtgatcgaagtatgtgatttgactaaagtaaagttaaaatattggtaagttttctcccctgctggtatatgtcacacttggtatagacaggccatatctactatcttcataagttagtaaagattcacatctgtcacagatgtgaattatagcctggtgccatgaattcctgaggcaaccttcaagcctgctcagtttcctggagaagagaagtaaacctcattaagaatatgtgatgtgtttaacacttcatgtatatgtcatctaacttaatccacttgacaaagccagacctcagctcagaggtgatgtgacagtctcctgggtcatagctgccctcccgctgacagcctctcttggcacctcttttcatgttttcatgagtaacagaggtgggacaaaccagataggtctgactccaaagcctatgctgaagagaatgccaaagagaccaccattttagagctataatgtattttttagaattacagcggggatgacatgcacagtccaaagttgttgcgcccccattatggcaaggcagcatgcctgcatctaaaaatctagaatactccttcctttctttctttctttcttttttttttttgagacggagtctctctctgtcacccaggctggtgtgcagtggcgccatctcagctcactgtaacctccacctcctgggttcaagcgatagaatactcctttcagtaagtctccttaactggcttccctttccctttttgagggtgtgaagaggacctgattcctggggcaggctcaggcagttttgctgatagaggagtagacaagcaaatgtgtggtaccactggcccctgcaggttctagttgtcttttagttttactggggccttcatacctcagggtctggtggcttctcttctctacccttttcttaagagtcactggtgtcataaagccccagaggatcaactctgtatatcagcctcatgagaactgaccttctcctgacctcattaatgctcttatttaaaagttctctaattaagctttgtattttgatataattagagactcacctgcctgtgtcttaaaaataactctcccagctactatctcacatgatctgtgggcccatcttgtgaagcctagtattaaaaaatatttttgtttttcagtggcgtgcattttaattctcaggccatagctcctaccattgaacagattgaccagtcttttggcgcaacccatcctggaggtaagccaagtccatctgattcctctggtcatcagtggcagttcatagcaataaacctgcccggtagtgccatcccaccccacttcctggagtcaggctcccataggattgtggggttggtacttgggtgtgaaggaaacatcctcccccttgttttcaacctagtaggccagtttagaaacaagccacagggaaggtgttgtcagtcattactccctgccaggctggtttatgttagccatttcagatgccagtcaaccatgttattttcttctcccccacccccaacagtgtacaactccgctgagcagctcttccatctcaacttcagaggactgtctttctcttttcagttagactcatggactgaggctccaaagtatgaggttagcccttcctgtcccctggtgtttgttgtatgtgtctgtggtatggctcagcagatggtgtcatgggatgggaatagaggagtgggtattagataggcagactttctttggtttccatgtatttgagctctacagggtaaagtggtagagtgggtgggttgacagaggaagaacaatgctcaggctggcattccgaggaagaggatacttcccacaatggagtgaggtcaggctcacttttcagagataagttcattcattccttattttcaagctcctaatcaacagttttcctggtggcctagaatttggagatttcatcctctggattttcagttacctttgtttttgcaaacatttcattcatcctaggggctgtgaaaatgataagctttcataagacttattttaattaaggaagcatttctgcattttcccctatgaagaaaaggaaaactgaccgggcatggtggctcatgcttctaatcccagcactttgggaggccaaggcgggcggatgacttgaggtcaggagttcgagaccacgttggccaacatggtgaaaccctgtctctaccaaaaatattaaaaaaaaaaaaaaaaaaaaacaggccgggcgcagtggctcacgcttgtaatcccagcactttgggaggccgaggcgggcctcctggctaacatggtgaaaccccgtctctattaaaaatacaaaaaatttagctgggtgtggtggcgggtgcctgtagtcccagctacttgggaggctgaggcaggagaatggcgtgaacccgggaggcggagcttgcagtgagccgagatcatgccactgcactctagcctgggcgacagagcgagactccgtctcaaaaaaaaaaaaaaaattagctggttgtggtggtgcacacttgtagtcccagctactcaggaagctgaggcaggagaatcacttgaacctgggaggtggaggttgcagtgagctgagatcatgccactgtactccaacctgggtgacagagtgagactccgtctcaaaaaaaaagaaaaaaaaagaaaaggaaaaccaagcagaattaaaggtggacttacatggttttggggagtttactgacccagagccagagagccaggtttaagggtgtactttgaccctttgacctgagcagctcttgaagaccatgagtgacagggaagaccagagcctgagtcccatcacctgttgtgccctaagtaaaactcttgacctttgtttgcagcccaattttgcccatggcctggcttctctccagataccccatggagcaactgtaaaacgaatgtacatctacagtggcaacagcctgcaggataccaagtaagtataaggagcatgagtttcttgctaaggcctgggctgcctgggagaaagaaccaagcctctgctcattctgtgtctgtccccagggctcccatgatgcctctgagctgtttcctgggcaatgtctatgctgagagtgtagatgttcttcgagatggaactggacctgcaggtttacgacttcgcctacttgctgcaggtcagtgactggctttgaggttggtacattccgcattatacccatgttgagacagtctaaaatcccacgtgcttagggtgtgtctcagtccattcaggctgctataataaaataccataaactgagtggctgctaaacaacaaaaatttatttcttgcagttctggaggctgggaagtccaagatcaaggcactggcagattcagtatctggatgcgcctgcagtctagttcatagaagaaacttctccccgtatcctcatatggtgcaaggggctagttaactccctggagtctgttttttaacggcactgatctcaatcctgaggtctctgcttccataatgtaatcacctcccaaagccctgaccttctaataccatcaccttggtggttaggatttcaacatatgaattttaggggaacaaaagcattcagtccattgccacatagttggtagaagacaaatgatgcagatgtttatggttaaagcttttgtttagttttgtcaagggactggacatagtcttataattagcaaatcttaataagcaacagcactgcttctctcagcatgcacataggcctgctgtgtgcttatatagctttgtgacagttcccaagtgtttcctggagatgcatcctgtgggttgcagtgctactgctctccccttttttgtttttttctttttcttttttttgagacagagtcttactctgttgctgaggctggagtgcagtggcacgatctcagcttactgcaccctctgcctcccaggttcaagtgattctcctgcctcagcctcccaagtagctgggattacaggcacgcattagcacacccggctaatttttgtatttttagtagagacagggtttcaccatgttgttcaggctggtctggaactcctgacctcatgatccgcccacctcggcctcccaaagtgctgggattacaggcgtgagccaccgcacctggccagctctccccttttttctacctttttttgttttgttttgttttgttttgtaagagatggcctcattctgtcatccaggctgtagtgcagtggtgcaatcatagctcactgcagcctcaaaactcctgggctcaagtgatctcacctaagcctcccaagtagctaggaccacaggcatgtgctaccatgcccagttaatttttgtctatgtggagatgggtcttgctgtgttacccagaatgatcttgaactcctgggctcaatcgatcctccctccttggctttccaaagtgctggtattacaggtgcaagccgctacacccagcttttctccctatattatccaggccggtgtgcattggaatactgtggccttgaactcctgggctcaagcaatcctgccttaacctcctgactaggctacaggcacgcaccaccatgcctggctctcctttttctaccctttatgccaagttctcaacgtaggcaagcagacgggacttgttgaattgtggtttggccacaccttggccagagttttgccaaccatgaacaacaacaacaaaaagaaatagttggccgggtgcagtggctcatgcctgtaatcccagcactttgggaggccaaagcgggtggattacctgaggtcaggagttcaagaccagcctgaccaatatgatgaaaccccatctctgctaaaaatacaaaaattagctgggcgtggtaaagcacgcctgtactcccagctactcaggaggctgagacaggagaatcgcttgaactcaggaggcggaggttgcagtgagctgagatagcgccattgcactggagcctgggcaacaagagcgaaactccttctcacagaaaaaaaaaaaaaagagtgccaccttcagtagctggtccctccaggatccatgcctcattttgtgacattcccatgcctggccaacttcagctgctttgggttgtggatcgtgcttaacgggactgggagcttcagcgtggagtttgttcccataaagagagctgagaaccttcgtggagctcattgcctaaccagcatttattcgtaaattgggttcctgcatcagtctctgaggcattgattcctttttttttttttttttttttttttttgcttcttttttctttctttgagacatggtctccctctgtcacccaggctggaatgcagtggcatcatcatagctaagtgcagccttgaactcctgggcacaaggaatccttctgcctcagcctccgaagaaactgggactacaggtgcacaccaccacacccagctaattctatttttttgtagacacgtggtctccctatgttgcccaggctggtctcaaactcctagccttaagcggtcgtcccacctcagcctcccaaatggttcttaattattaagaatctggtatataggctggacacagtggctcacgcctataatcccagcactttgggaggccgaggtgggcggatcacgaggtcaggagattgagaccatcctgactaacggtgaaaccccatctctactaaaaaatagaaaaaattagccaggcatggtggcaggcgcctgtagttccagctactcgggaggctgaggcaggagaatggcgtgaacccaggaggtggagcttgcagtgagccgagatagcgccaccgcgctccagcctgagcgacagagcaagactccttctcaaaaaaaaaaaaaaagaatctggtatatgaactctgagcccacttctgtgaacagttagacagttcacaaccttcacgttacgaatttcttaaaatgtgattttctagccaagacagaacaaccacttaaaggagtgtcatgcttaagctatggttttggggttttttgttgttgttgttttttgacagagtcttgctgtgttgtccaggctagagtgcagtggtgtgatctcagctcactgcaacctctgcctcctgggttaaagcgattctcatgcctcagcctcccaagtatctgggattacagacgtgtgccaccacgccaggctaatttctgtatttttagtagagatggggtttcaccatattgaccaggctggtctcaaactcctgacatcaagtgatccgcccgcctcaacctcccaaagtgctgggattacaggtgtgagccaccgcacccagcctgagctatagtttttgagagaattgagatgtggcagcaaagtcaagtgatttagtgtggttttttcccaagaggatcactgcttgaaacagcagggtggtcaaggatcagggtcattaatcatcccaggagacagcaggaggagcctgtcgagggtgggctctcagccaattatgtctgccaccttgtacagcacattcccagcagtcacactgctcactgcttacactgtcagcagggcaaatgatttgttaagtcagggcctcaaagggttatcgtcttcactgagagtttcctgtggcaagcacaagtttctcaacccactcatttctcatatccttccttatggaatatggctgcagtgatgcttttaatgcagggagtcagttcagccatctggtctccacaataatttgtagaaagatacactttggggaatcacaatctaaaaagtagctgaaactcttagtaattatacctggatatacttcaagcagagggagacagaagacttacctttgaagggtgccttccttacagcccccatctgacatccacacgtatctggtgcctgaagaaatgtgttaggccactggatactttgggcccagagtccagcttgacaggacttttggtgggttctataggtcacccaaggcttgcctaagcctttatttccccctcagtgtatacttgctgagaatagagattcttgggttagttgaactcagtatttagttatttcagatttgggttctctgaagcttctgcatataaaaaatggattgttacacatgagagaactttgacaactgtaaagccttgtgctgagtaagatggtgtcagtgattatcatggcaccaagaattacaatccttctcagattcttggcttcctttttttttttgctgggtggtgggagcaaaaaccttgtctccccctccacaaaatggggaaatttttactgttggtgtatctattactgtgccacaaccacttctacatttgtgtgtttgtgtgtgtgtcattaactgtaatcatttctgaaatgttttattagaaaaagtcagagcttaaagattcttcccaaagaataaacttttggcaaatcagaaggtcttttattcctccacttagctggtttgtcccttttgagtgataatggctcttgtctgggttggagggctctgtcaggtgtttgtgtagaattagggagacaagtaatgcatgcttcactctacttgttgatagagcagttttacaggttcagtgtctctggttaggggttaccattgagagtacttttgtagtttttttttaagacagtgtctcactctgtcacccaggctggaatgcagtggtgtgatcttagctcactgcagtctctgcctcctgggctcaagtgatcctcccaccttagcctcccaagtagctaggactgcaggagtgtgccaccacgcctggctaatttttatattatattttgtagagccagggtttcaccatgttgcccaggctggtcttgaacgcctgagctcaagcagttcaccccgcttggcctcccaaagtgctgggatcataggcaagagccaccacacccggccaagaagtacctcttaacataaatccttgcatcttaccatagttgtgtgatgatctgattaaggtcttctccagcacacataagctccagtgatggagcttatggagaaaaaacagcactgcctttttttttttttttttttttttttgagactgtctcagtctgtcacccaggctagagtgcagtggtgtgatcttggctcactgcaacctctgcctcctgggctcaagtgatcctcccacctcacccttccaagtagatgggactacagacacccaccaccatgcccagctaatttttgtatgtttttgtagagacggagtatcaccatgttgcccaggctggtgtcaaactctgagctcaaacaacccatccgccttggcctcccaaagtgctgggattataggcgtgagccaccacgtctggccagaaactgcactgtttttgttcacttttgtttcttcaacatctagcacaatgtcctagcccatggtaggcaataaagtagtgaatgaataagtgaatgaagtatccagagcttcatgtcacatgtgggggattgaataagtccctggcattattttgaatagcgatctcttgtacagtcttaagccctggtgacctgatgtttctgattgcatgcagtcttgccccttgccagacctaataatgtagcatgcagccagtagcttctctggggcccccagagagggtctctggtcctaaccataacctgacaacctctctgtcttgttttttgcaggttgtggacctggcctattagcagatgccaagatgcgggtatttgaacgttcagtgtattttggtgattcctgccaagatgttcttagcatgcttggctctccacacaaagtcttctataaatcagaagacaaggtaggggaattatgttgcagtctcctccttttttttaatcaacactaatttaatattgagtataaactgtttgctattttcccatagaacttgttctaagtaaagctaatggtaaagtaaattgaaaactgttttctaacccctgtagtccaattaccctgactctgtccctctccatagtgcctacctttccttagagaccaagacagtccctagtcaacgacagctggccccctctcctcctagattggtcagcaccagcagctgagactccccactcttgcttgttccgcagcttaatgttacacatggaacacaatttgtagactttcagttaatccagaactatattagagggatggattttaatttatggttattttttccctacagatgaaaattcattctccttcccctcataaacaagttccatcgaagtgtaatgactacttttttaactacttcactcttggagtggtaagttgtgattcctcagagaagcccttcatttctattggggtgggcagtgcatctttgcagatctgtgtgtccacatgcagctggaaccatgcctggacattggggaacctagccccagctgtctttgcccagggttgttttgcataggctctggtactccaaagtagaccttgcctgcaaccaggattgctcaggaacactaggttccctggtacctgttgacttcttttctgagggaaacatgttccacagatggaggccttggaaatcattcagattaagctgtttggagagctgcccttttgtaaagcataggaccctcttcttgagtcacaaaatggagactgaaaaggattggagacagtggggtgtgcttgtatatttttagaggaccaccccagaggcattgctgtatccctgtgctatggacccagggagctggatatagctggtagctggccagtgcggacagtccagctggtgggtgagttgcatacatgagaaattattgtataaacagtgtttcagcaggaaacatctcaagagggcagggctggcctggaccatgggtcttgtaacctttgagccttctacggtctgaggtcctgaggtagcaaacagtagatttcacagagggagtgaggagagactgagtctgcctaagtgggaaagaccaaacacaggagccaagagtagtaggggagctgatgtccggtcatgaactcctgagagtaggatggcggcaggagggaacagtgctgttgcagctggacctctggttcaagggccagtgatgatagtatctcaagaaacttagggtgttgcttttccagctggaaactactttggccggtggcacctttgccccaatttttgcttgctcccgctgggctcattcagctcactcagcctggcaggctgcgcttagctcatgctaccagcctggatcccatgcctgccaagggcaagccaggcatggagtggcaaggggtgtgtgagcgagtgaatgtggcatccggccactgtgcccagccaggcatgctgactgctgtggtggggcaggcagctccaggcgccagcataggcaccagctccacgtaagggtgaggctagatcacgtgtaccgcaagcggcttccattgcgggcacccatgtctggacaaggagaatgcggtggcacccggaagcttggggacaccaagaaccacacagagccccaaacagggtgtcacagctctggctcggggagctcctaggtctgggcttcctgaagggctgcagctcttctcttcttgtcacccacaatgtggaaagcggggcagggcatttcagccttatttgtgttacacctctttcagtcccaccattcggtgggtcccgagttcttgtcctgcggccaggaagaatgaggtatgcagacagctggagggtgagcaaaaaggagaggagctttattgggcaacagaacagttcagaggagacccatggtgggtagctctttctgcaggcaggtcatcctgacgagtatccagctctcagcagagagaagacccatagtgggtagcttctttctgtaggcaggtcatcctgaggagtcaaggagtcctgaagtgggtagcttcttcccacagttggtagtattgacatctgtccaagtctggctgaatccagggtttttatgggctcagaagggaggaagtgcatgctgattggtccatgagcaggcccggaaaaagcaccataaattctcactccacccacagactacccagagctggcagcccggcccccaggcctcaggccatcccaggcttgaaggtggggtttcacctcagaccaagccctttctgcccaggagcccttctgcttcctaccaccatcagcgtgccatccatggtgcccatgctgttcatgccgaggcggcagggggctagtgtgtcagtgctgccctgagtgcgtgcactcccaaccaggtcgtgacagcgcctgggctcagccacaactttgcccctccccagagcaggcaccgggagtggggagaggctaggtagtgggagcaggcactttcaagcctgccggggcaaggggccttctgggcccctgagagtgcagggatgccagggtctggagctgcagctgggaggctgcagctacacccaggagcatgggctcctgccctgccaacttagtagaggccagggctctcacctgttcccagttcccataggctctgcatagttctatgggaaaacagaggtcccggccacacttcctctgctccagtcggcatccttgcagcggccactccagatgggccattgctgccatcaataggtgacagggaagatggagagaatggactggcctcagtaggacttagttggctgtgggtacaggggtagagtcagaggttaccctgaggtcacgggcccaagcagctggatggatatgaagctggaaagggtaggggataggagggaagtgttcactgggtggcatcaaatccaggtccaagtcctagagagaggtcaggctggaacttcagttcctggggttgctgactcccacagagggtgtaatggaagccaggagggtctgatggattgtggaattcagaatagtcaagtggccttcagcccctcaagaaccaggtgacttggccagcatggtggctcacgcctgtaatcccagcactttgggaggccaaggtgggtggatcacctgaggtcaggagttcgagaccaacctgaccaatatggtgaaacccccatctccactaaaattacaaaaattagccgggcgtggtggtgtgcacctgtattctcaactcaaggaatcctcctgccttggcctcccaaagtcctgagtctgcatcctcggattctcttggctctgctgcttaccatctgggcaccacgctaggtgacttactgcacctcctggggccttggtttcctcatctgtaaagaggaacctgccttgaaagtttgtaaagcacctttattcagtaaatctttattgagtacctactgtgtgccaggcactactctaggagttcgggatacagcagtgaagaacacagacggacaaccctgccctcacggagcttatattcagagggaagaaagccacttagcaggacaaagagctaaaatggatagtacagtgtgttgagaggtaacacacatgacagaaaagataaggtatggggccaggcacggtggctcacacctgtaatgccagcactttgggaggccgaggtgggcggatcacctgaggtcaggagtttgagaccaggctggccaacatggtgaaaccccgtctctactaaaaataaaaataaattaaaaaaaaaacagccaggcgtggtggtgggcgcctgtaatcccagctactcgggaggctgaggcaggagaattgcttgaacccaggagacagaggttacagtgagctgacacagtgccactgcactccagcctccatgacagagtgagactccatctcaaaaaagaagaaagaaaatgtctaaaagctgcttggcctgtcccctggactgttgtctggaagaaaggtgatgcctgcaggcattcttgctgtggagtgcactggatgtcccaagttggacatgcctttggaaaggcctctgccctgcctcagtaacattccctccttgagtacccttgttttctatcccaggacatcctctttgatgcgaatacacacaaagtgaagaagtttgttctacacaccaattaccctgggcattataatttcaacatgtgagtacacctgtctgtacctcccctctgtgaagtgagttttgggctgaaaaccccaggaaagagcttttggctttgggtgttcactaatttatctacacctgaattcttgctgtttcatgggaagtgaatttcctgagtgcttgctgtgttcctggcacagggtccaatgccttacatctctctgtttgaacccattttacaaatagggaaataagttcagaaagcttgatgtcttatccaaggtaataggctctccagaacccagggccaagatcttttctgttcgacttccgtgcctaaatctggcctcccccagtgaacactgtcaggcactcagagccagggctttgggcaggtgtgtttggttctgtttctcctggggtgtggggttggaatatgggagtggccaggccttctaggaggcccagcctttacccatttgccttctctctagttatcatcgctgtgagttcaagatcccactagccataaagaaaggtgagtagtgaaagctctcagggtaagggaggggttttagagtctgttttccactatgaaaagggagaaagatcgaagcagtggttggatgtgtggagcttctgcccatggcctcagttcctctggggtgggctcattgttctgggggctgcagtgttcttggtctgagtctcctagaggcccttgaggcctcttcctatgactgtgggattgccggcctctggaggggagagtttcttatctacagatgatcatccagggggccccagcccatccttgttgcctgccacccactgccaattgttgttgctcacacctgactgacctcccttcacccctccatcctcttccaccctggaactccaaaacagcctgttaatcctccccatgtactccaaccccagtgcaaagggacaccaggtctggttcctacctagggctggggccacaggtaggctgggccagctacaaatctgccccactgtcttctcttttcagaaaacgcagatggtcagacagaaacatgcacgacctacagcaaggtgagcacctatcttcctacctggcatagcctgagaatgaggtggacatgagcctgcaggcagtatggggctgtgtcctctaggccagccattggtcacagacatgttcatgtccctactaacccctgctcccctctatccctcttgcagtgggacaacatccaggagctcctgggccaccctgtggagaagcctgttgtcctgcacaggtgagtgggagtttgatgtccccggccaccccacctgactcctcagagcccagaaagcccagggaagcctggcacagtggatgttgcttaaaaattacagaagtttctgatattgccacaagcatacttcctgccccactctgcacattaggactgagtcaactgttctgtgtgttcatctttgatagagagaatgtccccaggggtagctcccctctcccaagcctacctctaggtatgggggccttctcaccctcagttattcaataaggaaggagggcttggctggctggcctgggctctttttccctttgagctttgagctgctgcctgctgaagtccacagccccgttcctggttgccatgctgcctgagattctctcactcaagagggccctcttgactcctcgccaccctagtccagttccacagtaacttttttgtcctgttgggctctgtatgtataattctgagttgagtgagaccatccctacccctaggatcttgcaggcctgtgtgggaaacagacagacactcacagccatgagagactactggccagtatcccataccccagaaaagactggatcccttgctttaaggccgtggcctctgtctgcctctctaattctgaattctttggcctcaggtcttcctccccaaacaacaccaacccatttggttccacattctgctttggtcttcagcgaatgatctttgaggtaagctgtggaagccctagaaataaactgcctggggggttgctggtcatggcagggccaggtgaatgatggagggaaattggggagggcatcactgccatagtgggcagattcatccttcttcagcaaccgtgtctgctgcatacctggcctccccacacttaacaatgaaggttcagaaatgatgttgagaaatctggggtcacagaggccgaagcagtggtctgtgtccaacaagatgggaggtaacggatcccaagtttctatctgacaacatgattatagcagggaagggaaccacagggcaagtggggcccagcagagggtgttgggggccctccagtggcatgtgaacaaatgcattgtaggggagtgagtggctctggaggccctgctgacttgggagaacagcaagctgcccttgttttccctgtggatgcagtatctccagcagacacttaacagttccagaaggactggacacgtggccatggtaaaggctgtgtgtaaccattgagaaacaggcagatctcaggcagaggggggcctttagcatgaaccaggggaggttgaggagtcgggaaacccagccattaggtgcaggtatgtcacacaacctccagccctcatgcacaggatctgcctacatccctttacctctcccccttgacccactgtcctcttctcacaccaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacctgttggacaagagatggtcatctaccacccagccttggctcgctcaaagggtcaccattacacgggtttcaactggttccagcagggtggaccgccaggagccaagcttaacccccatcccctgggatcctgtggagacaggcacctggtgatcagggaagaaccacatacacggcaataatctgggaaaccggctccattctgggtctgagttaggagcttggggctgtagtggggagctaggagtcccattggaaggggcctgcagcgacaggctgtggatgcgcacaggctggcccatgcggcccgtgcagcaggcgccacataagccagatgtcagcggccgagagcccgtgcactacaaccagctcacggtaaaagcaggggtcgaaggtgctcaaatgcggcgcggctgaaggctgggggatgccaaaggtgcggaaggcagggtgaggctcgggcgtgagccgcaggcgctgcagacacatgcccagaaagacgtcgtcgatggggaagagctcgacctgcgcacaggcgccagccaggcggtgcagcgtggccccggaaagcacaaagccaccgccgcccgcgtaggccggataggcgggcaggccgtacacggcctcggggatgtagtacttgctagcccgcgtgcggatgggccgcgcatgcacaattacgtcaccagcaagcaggtcttgcgccgggtcccgcggcgccaggaactccaggagatttcccacgttcacgaacacatctgcgtcgcccttaaaaacgaagcgcacgtcggggcagaaagctgaggcccaggctagaaagtggatctccttgagcgttaggttaaaaaaggtgtcgtcgaaggcccagagcaggatgtccgcatacgcaaggctctcggcccgcagcagggcgcgccagtgggttcgcgcgccctccccaacttcgtcggccccgcccgagcctgcgcccctgggcacgcccagcaagaacacgcggcgcaccagcgccccctgcacgcgaccctccgcgccccacgtctggcgcacggcttggcgccgctcgaagtcctctgccaccgacttgacagcaataagcaggtccgggcggccaccgggtgcgccgtcgccgcggcacttgtgcggctggttaatgagcagtggaaaccgccgctggtccttggcgcgcaaatagcgggcgaagtcaaagggtcccgtaggcgtgggcggcgccggtgtgtccccttcgtaggccggcggggctgcacccgcgtcgggtaactggaacgcgcggggtccgggggtgggcctcggtgccgccctccctcgccctcgcggcgcgctcgccgtcggggccgcgccgtcgcgctgcgcatagagtaagaggcccagggaggcgccaaggagcagcgtgagcaatgcgtccctgcgtaggcgcagcctcctcctcatctccgcgcggcctgcgccctccctcccctgtaagggtcgcagtcggcagcagggggcagcgagccccgccctccccagctgagggggcgggaggccacgccccggggggggctccagcgaccgacggttgagccccttgcgttgttctcctcctcccggccgtgtcgcaccgccgggaccggcagcctgaagggacaagaagttcacccatgtagccaactcccccgcggcctcagctccggcccaggactgcgacccagggccgggcagggagactgggagcctcggcccctcccccgcccgcctccctcgcgctgaggccgaatcccttccaccctgccatcccctcaatgtcgggccctggggtcccgacactcacgctcggccctcggaagtggcgcagccccggacgccctggcctccggggctcagcgcagggtccgaggggccgccatggaccgggcccgagccaaatgcagcgttggcaggaagggggaccggtgccgtgccacgtgaccctccagctgtgcgcgcccagacttctggagctcagctccgccccggcgccaggagcactccggcctcagagtggggactaatccctgagagggagcctcctcactctcagtccctctgggaagggctggtctgggtgctcacaccccaaattcgcctttctggggattgggaagaagcatcaactcccctggttagctcccccaactatccactccccactcccgcgtctctggagtggggcggagcctgggctgctaggagcccctgagcaggccggttccaaatgcgcatgaacctggccaccatcccgggcgggcctctcctcagcagccctgattccatcaggcagggtgcatacgctgcccccgagacacatggctgtcttcttactcctggttctgccatgctccccacccccagtaaacacacgcacgggacaaacaaggcagcccacccaatcctcagggcaactctgccagcagctctcattcatgcccagatggggacactggggggctcttcggggagttaagtgacttgcccaggatccaaaggccagaaagctctgcccccaggtcttctgaaattcaggccaggattattttatctgtccttgccccgctcattcatccactgggatacagaacagggggccaacccagtctgctttaatttcacaggcaagcacttcagcctgtctccccgggggctaatggacctgagcccaagccaggtgcagttctgagtcccctggtccccagcatagcctactgcaggtagaaatgatcaggcctgtgcagctgcaggtcagacagggctggcaaggatggggacagcttgggaagactcctggcggaggccttggctaaaggattgctctgggatgcaggtggacagaggtgctctgcaatggagagctaagtccttgcgcagctcagctgccagctctctctttcttggtcccagcccatgtggtggagcctggaatagacagcctctactggtctcttaagaacccagccccatcctctgtccaagggctatatctgctcctgacggcttcttcccaccaatgttcaatcttaaaaagccacctctctggctgggtgtggtggcttatgcctgtaacctcaacactttgggaggctgaggtgagtggatcacttgaggtcaggaagtcaagaccagcctggccaacgtggtgaaacccccatctctactaaaaatacaaaaattagctagacatggtggtgggcacctgtaatcccagctacttagagggctgaggcaggagaattgcttgaacctggaaggtggaggttgcagtgagccaagaacacaccactgcactccatcctgggcaacagagcgagactgtctcaaaaaaaaaaaaaggccagtcgtggtggcttactcctgtaatcccaacactttgggaggccaaggcaggtggatcacttgaggccaggagtttgagaccagcctggccaacatggagaaaccctgtctctattaaaaatacaaaaattagccaggtatggtggcacgtgcctgtaatcccaggtacttgggaggctgaggcaggaaaatcacttgaacccgggagacgaaggctgcaatgagccgagatcgtgccactgcactccaacctggcaacagagtgagactctctccaaaaaaaaaaaaaaaaaaaaaagccaaatctccaccctgagccttactctttttggtcacaaagtaatcaggagtcctctgctccagctttctccgcggcctcaccttccattccctcctgtgataaagcttcgggctgcctccaccatgactcagaaagacccctgactggtaagctccttttaactgagtccaacagacactcctcggtcttgactacccgctccattatagtgggtgggtaatcccctggtttccaaatctcctggttttcctccttcctctttggctgttcccattctggttggtgtccttcaggacatcccctggggccaccccacccactccccacctgtctattcatcaatctttagattgaaccctcatcctgaactcagaactacagacccaactaccctcatactctctccccggatgcactgcaggaacatcatgctcaacttgtcccaaacagagcaagcatttcatttccccccagggccccatcccagcaagcagtcccacccaccatccaactggcaaaggcagaaacttggggccctctctcagccattcctcacccagtgtcaccaggcctgttactcttccacccacacagctctttggtggtcatccccttccctccatctctgctgctactgccccagcctggggccaccatttcccccacccccatcctcatcaacctcccagtcttggccaggtgcggtggcacatgcctgtaatcccagcactttgggagaccaaggtgggtggatcacctgaggtcaggagtttgagaccagcctgaccaacatggagaaaccccatctctactaaaaatacaaaattagctgggcatggtggtgggcgcctgtaatcccagctacttgggaggctgaaacaggagaattgcttgaacccaggaggtggaggttgcagtgagccaaaaacgtgccattacactacagcctgggaaataagagtgaagctccatctgaaaaaaaattaaaattaaaaaaaaaaaaaaaacaaccacctcccagtcttaactcccgaaactcttcaaaggcttcctactggcctcattgaaaaacccacaagccttcctcaagcccttgcctgagactgtgccccgaacactgcccttctctcgatagcccacccctatgcctactcacactcatctcctccaggaagcctaccccctgtcccctgcccaggttaggccccttcctccatcctccacaacttctctttttttttctttctttttttttttttttttttgagacagggtctcactctgtcacccaggctggagtgcagtagctcagtgacatctcactgcagcctcaaccttccatgctccagggatcctcccacctcagcctcctaagtggctgggactacccaggctggtctcaaactcctgagctcaagcaatcctcctatctctgtctcccaaattgttgggattacaggtgtaagccactactacttgtatttctcacatcaaaatccgtgttatactttattatcattgcttaacattcggggtcccacgctgagtgtgagctgggggcaggcaagattgattcctgttttacttcactgcagtatctgcagcacccaggatgaagtccaggacaccaaagatcaaggtgcttcatgagtgaaactgtaagggctggctgtaagccccgcttctgggatgggagaaggtgaggctgatctccaaagcaggtcccccccaccccacactctatcaaagtacctgaggcagaatccccaatgatgcacccccagtggtctggctcctggggaaggcaatcaactctgccccagcaggtccagcagataggccaagtggagtttcagggtcccgtggatggacaggggttcagcaatagccgcagaaggaaccctaaggccatccaggttctccaaaagctggctgcacccctggtctaggccaggccgccattgggatcggtcaggcccagcaagtcctctgccaggctggtgagctcgttctcctcgagtgcctccaccaggcgctgcagcgtggcgcggcggccctcggcctgcacgaagcgccgcagcagctggaaggcctgctcgtacagtccctcgcgctcgtactcgtaggccagcgagtccagcgccgggtcccgcagcgcccggcagcctcgctgcagtgagcgccccaccttgcgccatttgagacccacagagcgcgcgaacgtctgttggtccttcaggctcagcggccgattcactgcagagggagtggggaaacggggtgagggcggggacccccagcgccggtcccacccatccccacccggcaacgacccctgcccctccccagactccaacctcctggtgaccccgcctctccacctgcgcctcacctacaggctgaccctggaacagaaaagtctgggcaggtggcggcggcggcggcggcttcacctccgacagagagggcaccgggggctgcaagggggccgaagcgacctccccgtcgccaccccgggcccccgagccgcacttcagatttcgcagcgcatcctccagctcagccagttcttcatcccggagccggtcgggctaggggaatggaacgtgccgtcacgggggacttaaccgcggatccccgccctaccccatcctgaccctagcccggccgcacctgctgggctaggatgcaactcaaacagcgctcctcgtccgccagcaaagcgtccagccgctcggcgccggcgcgcagctccagttgcagcggcaccgagtgctgggcgagcgcggccgccaggctcctctgcagcgcggcgcgcagcgccccctcgcggtaggcgcggaggaagcggccacagggctgccgcccgcagaatcgcagctgcacgatcagctgcgggtcgctgcggtggatcttcagcatctgcagcacgtccgggctcccgccgctctctgcggaggcgggcggtcaggcgccgggcggtccccaagctcggccgttctccaaacggccggaggaggggcgaagcccgtggtgaagccccgcgtcccatcccctgacctagggtgcagttaccccagagtacccagctgggaagcaaaattgggatacaaacagcaataacccagaaagaagaccaggatctgtcacagggagcaccctaagacagagtgggtgccacctaacccccgctctcacgccccaaatgagggttggcaaaagagagggacttcgaagcacagaaaagggggcgtgtgccctgggcaaacaagccgtctgggtaggcggccagcagggcagaggagggcgagaggtctcaggtcttcggcctccaccaagcgcgactcccactgctcgggaagaagaggggctctcgccgctctgaggccacgaacagatcccccaacccgcttcagcctcctgtggcctctgccctgagatgggaaaggggggcctggaagggtaggtactggggaggggtcttgagcaaggagtgctgcagtaagagaggaaaagaggagagagacatccacaattagtagaaaggagtgagccggctggtggaggggggcggggatggagcaaaggacgttagtgcacaaattggtaaatcatacacagactcgagaacacacgcctatcctcaaggtcatgccacaagcaaagaagagagtctgcacagccaggggtcctccgtcttgctcctcccaccccaaatcttcttcttaaaggtggctaaacccaggcccacccacaaaatgctccaggccaccccttcctctccacatgcccgcccatccacgcacctgccaaggcagcctgcagagccctgtacactgccaccttctgctgggggtgcgcgtaggcatccgacaggaccaccttgtccagcgaggactccacaaacaggtatgcgctgcccacccactcttcgtgcccattttgcccagctgccatctcacctcctggagatgcagacagtcaggtatccagttcatcccccctccctccaccctggagacaactacccagccccacgtggttcagctgtccccaccacagtagcctcaagtcccacatggttcagttgtccccaccactggttggcatacttgggacaggagttcaccatctcacaggaagccccttgagctcctggctctgtacagagtcccacccgccccaggcttgcagtgaggactgtccctccactgccttcttggagaaagagcccaaggtcacagtggagggggagcagaggcagatcctgcaatggggcttctctgcttccttctcaggcctgtgtgtctctcttaccaatgcggacaagagacatcttcattctggatggtgcccatgccccaaagccaaccagacccatatcctggccttgccttctgagtagacttgagcccagcatttctggaggacctcagcctaagactaaacctcctgtcttcacttcgaagggcacctgtagtttgcatctacccagattctctccccaagcctgacttacctttggggacttccctcctccctcttctcaatccatgtgcctgtgtcccactccctagttccaggtcgggcttgtgtaccagacctggccaatctgcatattccattcacatttctgcagtgattagttcagggcggggtataggacttaagttggacccatgagaatcaacgctgcgactctggttgagccaataggaaagaggcactactttcccttcccttggggctgaactggaaggaaaaggtagctctcctttagcactgcttgggaagagcctggctgggaatgaagctgacacagaaagaaagagtcaagagatggagaagtgcattcctaagcatactaggcccctggatccagccgtccctgaagccattgcacactggacttttcagttatgtgagctaaataattcctttttgttataaagcccttggagttcggctccagtcatttccaacacaaattgctctattccttccctgtccagaaaaagccagggccccttggtgctagtatagtatctccttcctccatcttctgacaaaaacctagctctggaccagcgggggcaaaattcccagccaaggaaccactgcactgacctacagctcaatggtctcccagttactaccccgtgagacagcaagtagaaaactgcctcctctttctccccacctcacccttttcctacccacccttttcctataatcatgggctcaaggccctacctcctgccccatcagtcacactcctgtactctcatcagggtttatatatggtgggctaagaggagtgttgagtgttagctatggggcaggacagatggggtggcccagctgccatctgtttacatgaggaacaggaagctgtcctcctgccctggcctcccaaagtgctgcgattacaggagtaaggcactactctcgacctttgttttttcaattgtcttgtttttgagacagggtcttgctctgtcacccaggctggagtgcagtggcactatcgcagctcactgcagccttgaccttcccagctcaagcaaccctctcacctcaacctttcaagtagctgggactttaggcacacgccgccatgcctggctagtttttgtatttttagtagagatggagtttcaccatgttgcccaggctggtctcaaactcctgggctcaagcgatctgcccacctcagcttcccaaagtgctgggttacaggtgtgaggcaccacacccagccttctaatcttttcatagaaaacattaatacttgtgtacttacgccaaaccacagtctggatagtaacaggaagtttgcattttgtttatctctgggcaggatgaaggaaggtaggtgggggtggggaaggattgtgggtgatttttattttctttgtatttagcaatattttctgctttatgtgaagtagacatattttctttgtattaaaagagcaaaataaatttgttttctttaaaagcaaaacaagaaaaaacaggaaactctgcaggtgacaagtgggtccataatagggagccagccacggaggtgagataaggggggagtccttcgaaagtggcctggggagtaggagagagtgggaacttcccctggaaacattccctctttcatgtctttctggccccttgacttgagagtgcttgacttggttatggtcccaccccaaggggtggaagtggggaccgaacaggaccattgtctgcccatcaggtctgtgggggtcgagggggaggtggggagtactgggaacctggagactggggatgctttctcacactcactagtactagaagatggggaaggtgaaccaggctggaggtcgagttaacagggtaaagaggccagggccctagtttcgcatccgccgactggcagctcttcttacgtgttctttcacggaagcccctccttgggaagccccgcgccccacccaccaggagtcgtccctttttgggcggggctgaggcttccaggctgggtcctgagaaagtttggtggccggagactgtggggcgcttaggtaccgacctaacaacttctgcgcctgtttccagggacgagccacgcacggtgccccctgaacacctaacagtcccgggggcagccccacctctggctgggtggacagagacagcctgtgggcgtggcccagaactgaaagcctgtgactccttgcgacccgccgggcacaccccctactcagctacgcagctcccgagcgcttgaggggagcttcccaggctcccactagcccaccctcaagctggggtttcgcacgtgcgatcggctggggtgggcaagggggtctccgctcaaggaaagtattcagaaccagccccttctcccccaccctctctcctgcagggccctactgcacctcgaaagtgctggcagggacgaggagcctgcgggggccaaattccgtaccgtcccccgcctcccacggtgttcgaacagctcagtagaccgccgccaccagctggctggagcagccgccggtgacatctgcgccgcgcccacgcttcggagccaagatccacctcctctcccgcccgcaccggggagcccacccacccacctgctgcactaacctggccgcctcggcggggcctgggttcccacgcccgccaggctccgctctactccgccgcttccgggtgtgcgcggaggcgctggggcggtgccctagcccgagccgccccgtccgcccgcgcgtcccgccccgcgggctcccggtggctgcttcccgtccgctgtcctctgctgccagtcccctgccccgggcaaagcccatctggtccgccgagcaggtaagacaccagcgcccaaggttagacggcaggaagacccgactttgggggtttgcgattcttacgaggcggggggctcgtaagagctacagctgccagacttcggtaaatcaagggggcgccccctggagaccagaattttctggtacccctggggatccggcttcaagatcgctgctaccagtgggcactcaaaacggggtgcccatgggtcccaggtacaagcccggccgaacgtatctgaagccccaggaaacacgtggcacaaattccgggagaaactgttagcccggaagatatgggaacattaactggcgagtagtgtgaagccttgtgtacacaaacctttaagaaccttaaaacaagattggcggccgggcgcggtggctcacgcctgtaatcccagcactttggaaggccgaggcaggtggatcacctgaggtcaggagtttgagaccagcctggccaatatggtgaaaccccgtctctactaaaaatacaaaaattagcccggcgaggtggcgcgcgcctggagtcccagctactcgggaggctgaggcagaagaatcgcttgaacccgcgaggcggagtttgcagtgagccgagatctcgccactgcactccagcctgggcgacacagctagattccgtctcaaaacaaaacaaaacaaaaacaaacaggattggcaacttcaaagaggacgcacactttccagtaacccatccccctctaaaggctgcgctccagggtgggtctgcggagttccagccgaacccaaattgctcagcgggagccagggctgctcaggggtcggaacttaaatcttgagcccctcaggccccagaaccgtcaggtcccagagacccaagttttttttcatccagtggggctgtcttaggaagcacccgggacatctccccggcgaggcggaggcggggaaggagcctcccctccaggggtggatccagctttgccccgcccacgcctcgcttcctgattggctcatggtccctgacaaagaaaagcctacattaacgctcccgccttattaaccctgtagtcactttctactaaccggcggggttaagatggggtttctcaggccgggcgcggtggctcatgcccgtaatcccagcactttgggaggcccaggcgggccgatcgcttgagcctaggagttcgaggtcagtctgggcaacaaagcgagacctcgtctctgcaacaaaattacaaaaattagccaggcgtggtggcgtgcccctgtagtcccagctactcgggaggctgaggtgggaggattgcttgagcccgggagactgagggtgcagtgagttgtgattgcgccactgcactccagcctgggtaaagagcgagaccctgtctcaaaaaaaaagaaaaaaaaaaaaaaaagtgggaggggagttctcaacgtggaacctgtggagtcacaggggcttgttgaaatgcagattcctgggccttaccctttccggagagcctgatttagtaggtgaggcggtgaaatctgctttgtgaacaagtttcggggttatctgatgccccacgctgtctgagaggccctcagttcctcaggccacaagcatttgtacacctaagctcggtcttcctgcaacactttgcgccttcccgacctcagagacgtccgtctctctccaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcaggtgagcctgctcctccacactcctctccccaccgcccactcaccttctccgtggagtcgtgggctaggtagatattcaggttgactcccccatattaaaaaataattgctggccgggcgtggtggctcatgcctgtaatcccagcactttggcaggccgaggcgggtggatcacctgaggtcaggagtttgagaccagcctggccaccatgctgaaaccccgtctctactaaaatacaaaaactagccgggcatggtggtgggcgcctataattctagctactcgggaggctgaggcacaagaatcgcttgaacccgggaggcaaaggttgcagtgagccgagatggcaccactgcactccagcttggcgacagagtaacagtttatctcaaaataataataataattgctgacgtattgactgcctagtatataccaaccattgtttttaagtgccttacatatattaactaatttaatccttatgaaaaccttgtgtggtagataggtattatcattacctccattgcccagataggaaactgaggcaaagagacttaatcacttcccacgggtcactcagctagggaatggcagaggcagaattcgaacctagcagtccggaggccatgccaagactccttagagacagctgagaaagcccagttcctaaaatatcattggctctccatgtccaggtttcatcctgtggcagacgccactgaaatcttctaaaaggataggatgcgagttccctcctttggggcaacagtcgtggtctgaacagagacgtggggagggaggcaggaaatgggatggcagctggaaccccagctaaggggtgggtagaggcttctccgctggtcgcagggactcagctgaggccttttctgcacggctctaacccaagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgcttccctgcccccccttcctatctgcttgccctgcctggggcttcactgtgcctctggccattaccttctaggacttgcccagcccacaccaggtcgcgcaccggcgatttctcctgtagaacaaagaaggaaatagagggaccgagaggggtgggactcgaacccaagtctcccactcatctcaccccaccccaccccactccaccccaccccacccctccactccactccactccacacatcccatccagccagccttttctgcctgctggtgcctcggccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcctgagactgggccgtggatccccggatttggccattcagagaagttcaccttggagggggtgtgcgagaggggggtttcctctgcggccgaagaagggttaggagcctgccttctgaagacctagagtccgagggaccttcgaggccatttagttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtgtgagtccctacggccgggcggggagcggggatgggggactcggtgccggggatggggcgacccacgcccccacgccccactccccagacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgggggcggcctgcgggaatgagcaaagaggaggaggggtgctgggactgcctgccttgctcctgcgacccagtcccgacggtgcctcccgcctgcaggtgcccgcgctgcgcggcgacgacggccgctggcgcccggaggacctgggtcgactactgggcgaggtgcaggctttgcggggagtgcaggagagcaccgaggcgcggctgcgggagctcaggcagtgcgggggcgggcggggaaagaggggacaggggtggggggttcgggatgagaccataactggccggccagcagttctgggcagccccttcctctctcctgccttggcgcctccatctagacttatgggcgatctctgggatggccagtcagcggggtggtctcctgggtccccagcctcgccattctgtggggggtggtgactgggcgaactctcagatgcctcagcaccctcccaccccttcctcaggcagaacgagatcttgtggcgggaggtggtgacacttcggcagagccacggtcagcagcaccgggtcattggcaaggtgttcctctccccaagcctcgcttctccctcccactcctcgacaccccattccaccgcccagtcccccggcgcccctgttaagccttcctccctcacctggaagtgcgggggtgggggggctgtgtccaaagtatgaattaaacctttgctttctcttcagctgatccagtgtctctttgggccacttcaggcggggccgagcaatgcaggaggcaagagaaagctgtgagtgagaaagccaagaaggcccacacccacttccaagaccccccagaagtccccttgcaaggaccccttctcctctggaaactccttcaccgggaatcctcattcctccccctgcgctacaggcttcctcaccccatctaggatccacttccccccaactctgccacctggtatccccactcccagatcctcccattccaggaccttattcccaaattcctaccccagcagccccttccccctccggcaaggcttcccaacagctgagaccctggggctcaaaccaggttccctccctcccctctctacccacaaagggcccccatctctagggggagccccttccacctccagcatgtgactgacaccctagcaacaggcctcagctctgctgacttggctgctggggcctgagggagggagggaagtgcaggccgaggtgcatgggggctgaccctgccccacccctgcctgtgccctgatcgaccacacaggtccctgatgctggatgaggggagctcatgcccaacacctgccaagttcaacacctgccctctacctggtgcccttctgcaggacccctacttcatccagtcggtaggtttgtcttcttcccccttcccaagggcatggctgggcttatggagagcctgttccttctccccatcccctaaaaggaagagaagatggaagccagccttccccccaaccagacccaggccctccagcatggactgagcctcctccctcaaaccttctcccttagacctggcccaggtgggtgttggtggggttctggctctccctgtgcctacaggccaagggctgggcctagccttctacttacagcctctcccagagacaaatttgggccttagccctcacagggccaggggccccatcatctctgacatcccagaagactctccatcccctgaggggaccaggctttctccctccagtgatggcaggaggtaagggggacagggctgcccctgaggggcctgtgggggagggcctggcagcccagatggctgtaggggtagagggagaagtcagtgccagggtctggttgaagcttttctctggtgcagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacaggtgagcagagccccagctggcccatgagccctgtgatagaacagcccttaccagcccacaaagcttcctagccatttgactccatgatactcacctgatttcttggccccagcatcagagttctgtggaaagcagagcctcccagtcagggcactcagcatctgcggaagggcttaggaacctacatatgaaatgagttccctggggtgactgcaaagtacacaatagtttaagaagcattggtggctatgaggtggctcatgcatgtaatcccagcactttgggaggctgaggcgggcagatcacttgaggtcaggagttcaacaccagcctggccaacatggtgaaaccccccgcctctgctaaaaatacaaaaattagctgggtgtggtggcgtttgcctgtagtcccagctactcaggaggctgaggcaggacagtcgcttgaacttgggaggtggaggctgcagttagccaagacagtgccatagtgacatagtgggtgacatagtgaaactgtctccaaaaaaaagaaaagaaagaaagaaggaaagagagagagagagagaaagaaaaaagaaaggaagaaagaaagaaataaagaaagaagagaaagaagcatggatattgatacttgcatagggaggggaagggtcccaaagccccagctccaccacccaaacttcaggtcccaggtaggaagcagaggcactttctctgtgccatttatggcaggagtggggaggttgggggtggagagaggatggggatcctctcctatcattttctaaagattgggggattaaaatcttgatgcatctgggttccttgggaacttaatgcggggtggacactgcaggccaaaagcagttctgtctgcacagggggcctctgggcctggaaagcggggacaggagcccagagagtctgctgcctccgatgctgcttcagccccctcaagaaagtgtggaacctgcagggcctctagatgtgagtaccccttctgctgaaacaggggcatgagacctggtggggtctagctctctgtggagcctggggagggcaccactgacccagagctctcctcaggtgctgggccccagtctccaagggcgagaatggaccctgatggacttggacatggagctgtccttggtaagaagtgggtcggggagggcagaggccaggggtggctgagtcaagccctctggtccatagctgttctctgtgagccaaagccgtgtctctagaagaattgtcacagtgatttcccagctgtccccctcagctgctaggtcccctccccagctgctccctgcggttctcacgcagatgcagcccttggttccagagcggggtgagcctgagctggcggtcaaggggttaaattctccaagcccaggtaatggttgtgatgactcctacctgggaggacgccgtgattgggctgagctaccttgattgagtgagggggcaatctgcaatttgcagggaaatcctgagttcaggctgcactgcagagcgttccttgagccacccatgccctcaccattgggcgagagtggggaggttaagaatggatgttttatcctaactgagcagaaggcaggcgggcagggctctccttccctgaagaaaggagggggaacatttcccctggtgagcgcagtcccacttctcctagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttctgtttctggtctcttttctctatcgaccagggagcacaggagttatgggtggggggtgattttgcatttgtagaagcgtccagatactaggtttttaatagaggaaccccaggagggtggaggtgcttggggatccggtgcctagctcccttgcttaggcccgggtccagggctggcgcggggccgctgcaatctctgggaagcgggggcttctgggtcgcgctcagctctgcaatgcatgcgttctgtgatcctggtgagttggtatccttctctgaacttcctctgtgacaggcagagaagaggggtcgatgacaagatagatggaaagcacctggaaattggcaggccctgagtgggcgctggacgtgtggggccgcgggccgaactgccccctcctggcctcatctcctggtgcgccccgggtggggagggaaagctgactacatgcacgtccccagccagcgcgcggcctccgcggtgtggctcctagtgcccggggaagaaccctcaccctccctattcccagcagccctggccgccccgcccccgccgcagctgctgcacccacccccaccctgcccggccctttctgcaccgtcatctcctgccccgccgaggcttgacccgtgagtggggacgcccaaaacgggccagaccgggagccccactcccggctgtgggagggaagggaaaccgagattgggcagaatcagcgccccaccacccgctgcggcgctcgggggtcgggggggcggggtgggtaggactgtgggccccgccctgccgcaggactctcaagctctgggactgggtggagggaggtaaggggcggggggggaaaatccgtgcagtcgcacatgcgcaaaggctcttcactgtcccaagaccctggcttcctggccaaagagcccgcgcagcgaggtggggttgggggctgggacccagctccgtgccccgccacctggctctctgggaagaatcggacctgtcaccctcgaaggactggccgctaaataacttcggtattgagagctgtgtgagcctcaaagggagggcccagaccagctggagtctctacccccagacaggataaagggcaggacttggggtcataggaggaggcggctaacatgaaaacaacttaggttggagagaaggaggggccaatccaatctgcaccctccctgtgtctgtcccgagtaggtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcatagtgagttctccgatccctggctggtggagggaagctgggaagggcctggctgtccagggtggtgggaggaggctagagtagccagaccagatattttgggttgtctctgatgggcagtggggtgtgggggggaggtagataggtatttaggatggaattctgctagacaggaaaatatagttcagttcctcatagttcaggctggagcaagtaagattccagttttaccactgaatctctgagcctgtctcctcatctgtaaaatgggaacagcaatcctagcccagagggttgtcaaagtcactgtgctatcgggcctggcagaatgggagtgagaggggctcagagggactgttacaggacatgaggtgacgatggtggggtggcaaggcaggagctgatggagactcactgagaagtggagaagcaagattcatcacatacgggacataaagggagatggaggggcagggggtagtcctggtctcggcctggtggggaagggcttcaatgggaggaagccagggtgtgaagtgacgggggaggtatagtgtgacaccagagggtactgagaaagacctgggaggcaggatggcggctaggactaaatcctctctcccagagaaggccgagcctcctagagccagagaaggaggcagaggagggacagcaaagggaagaagagatgggaggatgccgtgtgaacaaagccaaggcggggaggagaagaagttattatcagggtgggggtgggctgagggcatggttcaaggcctgatgtctttgcctcctaatgccgggggtcttgctggctgggtcaggccactcacaggaatgggccataatccttggttgacaataaatggacaaagcagctgggtgcggtggctcatgcctgtaatcccaacactttgggaggccaaggtgggtggatcacgaggtcaggagttcgagaccagcctagccaacatagtgaaaccccgtctcaactaaaaacacaaaaaattagctgagcgtggtgcgggcacctgtaatctcagctactcgggaggctgaggcagaagaatcgcttgaactcaggaggcagaggttgcagtgatgagagaatgtgccactgcactccagcctgggcaacagagtgagactctgtcaaaaaaaaaaaaaaaaaatggataaagcagattgactctccctaatagccgctgttggtagagatagtctctcaagagccaggcatggtggttcacatggtggttcacaaagtgctggtaatcccagcactttggaaggctgagatgggaggattgcttgaggccagcagttcgagaccagcctgatcaatatagcaagaccaggacaggcgcggtggctcacgcctgtaatcccagcactttgggaggccaaggcaggtggatcacgaggtcaggagttcaagaccagcctggccaacatagtgaaaccccgtctccactaaaataaataaatacaaaaaatatatatagcaagaccccacctctaaaaaaaaaaaaaaaaaaaaaggctgggcacgagaatcacttgagcctgggaggcggaggttgcagtgagccaagattgcgccactgcactccagcttgggcaacagcgagactccatctcaaaaaaaaaaaaaaaaaagtctctcaaaatagtgcgatccatggaggaaaatcagtccaagttcggcaagtatttgtcggtatcctgtatgagctaggccttgggtacttcaagatcaaacaacaaatgtctgtaggtaattcccaggtcagcagggagccaggtgggtcagcagagagacagtcacattaggagttagggcttcagtagggagacaggtgggtctcaggtgatgtcaagagatcttggtcagagctaggcctgaagaagattctggtatctctgctcaggaatcaggggaccaggaagggccaggagactacattggggttgcactatggtggtggtgttggtgggagggtgtagaggcggggcttgtcctggaaagttggatatcagggtcaaggtaaggggagaggggcagggaggctctcagcactttgtgctctgggttcagaggggactggaggatagagtatggaagcagggagctctgatcctgggttctgcagggccaaagcaggaggcagaaggctggacttagtaagtggtgaggatggtgagagaaatattcagcagtcagactggaaaggacttgtctgcaagctgggtgtggagtatcagcatcaatcctaggtttttctgcctggttaggtggggaagcagatttgagagaaagaccttagtttggataaacggggtctgaactcgcctcggatttgccgggggtggagctcaggacgtcctggttggggagggcattcagagagtagatgccagtcctgggaaaggcaggggaggagaggagagccacggctgacgcttggggacagaaggaggagcctgaggaggagacaggacagagcgtctggagaggcaggaggacaccgagttccccgtgttggcctccaggtcctgtgcttgcggagccgtccggcggctgggatcgaggtgaacttaaaccccagcctgggtgttcactgggggcattgagggagtggtcagaggcggcgagggcagcggggagggcaaccccccattacttctctcccctttccccatgcagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggtgagcgcgcggggcggggcctagggcagagcagggacggggctggggcagacaaaaggcccggggagggcagggttgtcgtctccgctagaagtaggcgagtgtgaaaccgcacaggggtaaattgagcctcagtcactcccacttccgccccaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaaggtgtgagtccgcccaaaccctgagccggcttggcgggagggcatggcctgggaagcggatgccggaccccacctctttgaccactgttcccgtcatctctagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactgcgtttctgagttttacagatgggaaaactaaggccaaaggataggagtggggttcacacagctaagtctgaagggaaactggaagcagcaaccacctctgcacctcacctggtctaagaggggttcaggacttgggccaccaaactctagggcctgtccctcaggtgcaattgcagctgctcctaggctatgccaacctctgccagagagcagctgtgagggtgtgagcaaagacaggaacagcagaggccagtggagggagtggggaacagggccaagggagctcttgggcttgactctcaaggcctgaatcagtgtgtgtgtgtgtgtgtgtgtgtgtgtgtgtgtgtgtgtgtgtgtgtgtgtgtgtgtgtgtgtgtaatgggagtggggctgggaaaattggtgccttccaagaaggagtgtcctgtccaaccccccgcacccccacggaaccttcaggagctgctgctcccagccacaggaagtagaccatataaatatggaataaatacatgaccagtgagagaggcaaaatgtcggaaagcagaccccaggccagctgggtctctactaccaggaccccaggctcaggccatcaatcaccccaggagaagggagcccgacccccaccaggacccagtgagaggtagacagcacaaatgctgaaggagcaccaaggggccaggtaagggaagggagagactggagtactgggacaaccaaagccatctcatgcaagaacaagtttctattcccaaaccacccccatccccatcaatgctcagctctcttcctgcccccatgccttccctctgctcaacagagagctggaggcaggagggcgactcagtttgccagacatgctgctgcaggtccccagaccccagggaggctggcaagggacacaaacactttgatgttgccactcctcctcaaggaatgctcctgccctcccaacacccccaagaaacacctaggccgtggacgcacagagcaaactgcttcatgttctaggggcctatctggagcttctgtccagggcctctgactgcagccctcaacggacatcagtcgggtagcaggcgacccagctccgcctcatccagccggttggtggccatgatgtgctccagctgctgccggtagcgtgccaagtcctgcatgaagtggggcacccgggtattatccagcaccccatggggccgcaggtggtccacatcctcataggacacctgcaggaggaagccgggcatcaggcataggcagtggcccctggctttcaggtagctggtcccagcccactgcttacagctcacagcctttgctccgggacttcttcctctcccctcctgatccacaattagctacaacgttttatacctctagactcaatccttcatctttgccctttctctcaacagtttctttttgtcatagatgccctacaaccccacttctctctccagcccagcctctcagaccctcacctccaaacatgggcatccaactgcctccttaatgtcttcccctggataaccctcaggatggccccatgtccaaaagtcaactcctgagtgccagcttatgccagctccaccctctttacagtcacccaggtcagattcccgggagggggcttggactctcaccctcccatcagggtagccgctgagttaaaagtattcccctctctgaagagctctccagcttgtcccttcatctccaacccagcggccactgcctggttaggccagaccaccatcccttctgcaggagtgacaggcaaggcctcctccgtgcccctgcactcccttccctagtcctctctccaatccacctcccatatgatgtccagaaggagccttctgaagcaaatatcagagtcactcctctgcttaaagctcctctcactccccgttgcttcagatgaaatctactttcctcggcctggcacaaatgccagtgccagggagttggtccctggccatttctgcagccttcttcccctggccttcctgatcactcccttggcctggaatgctcatctcctttgagatgcagtatctacatacacctgcagcctccgttaagcacctggttttgctgccagagtcatttcatctcctgttctcacttccacccacgctcccccctaccaccacaggcctgacacccagccctcggtctagcaccaatccgaggctcagggaattctacagcaaggcagggagctggctgggacctctgaaggtccacagcccctcaccttgcccagtgaggtcagcaacgggaaatcgatggtctggcgatgtcgcagaatgcgcacgatgccgtccaggtacacctggtccttgctgaaacaacctgggagggcaggagggcggtgagccccgcccctcgcccgaagccccgcccccaccccggctctaggcacctcccccgcgctggcgcacacctggcagcgaggtgtcggtctggccgcgcttggcgcgcacgcagtactcccagcgcacatcggcgtcctgcacgtagcgctccaggtcctggaagagctgacggaaggacatgcgcgcggcgcggtggatggtgtagtagagcagtgcagcgcgccacaggaacggctgcttgcggaacagcacgctgtgcaggctggccaggccctcctccgtggggttcgccggccgcagcccgtaccgcagccggccctccgcgttgtgccacggctggcgcgcgttgttcacgccccgcaggtagtgggtgcctgcggggaaggcgaggggaggcggcgctgggcggggcgttcggggacccgcctgcgagcccagccctggccctgttccatctggccggggctctggccgcgacacttccatcctcatgctcctgaactcaggctcgcacacaggctctcccagccccaggcagcgtgaagctcctcctcctgtggactcgcacccaaggatccacagaggctcacatacatgaatcctctcccacccatccgccccccaccctacacccacgcacccacacacgtgcacgaactctcccaaactgacattgcccccagccctcctgggcacaagaatacatataccaccctgcccaacatcctgggtgcccatatcatcttgaacagtcatgctgatgcccccggtaaaaatcactcttgcccagagcaacaggattctcgaggaagagggacagacagataggaatagtggttagtgccctgcacccccctgcccaaactggccagtcccctcctaaaccaggtgccatgtgtcctcaagtcaagtccattcccaggacctggccttccatccaccctggagggccagcgtggtggctggcctggtgggaccctgagggttctttctctggccggtcagggcctgaccagccttgcccgcactgttgggagaagtcggagaggaagtggagagagaaaaatatacccgaaaggaccaagagatgagagcgagcccagagcatgggcaggcatgttctggcctacctctgtaagcagagggcgggaggtggctgctcaggaagggaaagccccgacctcaggagggaagggggagaaacaaaaaggggagttattggggcccctccttcccacccctcccagctcccaggcccctttcatgcctacccatctgcccggatacccacaccctgacctatctcatgccgcagcatgccctccaaccagtactggcgggctccggtcaggttgatcgccaatgtgggccggctgttctccaccatcatcactgcctgggacagcaggtcctcactcagctgcaccacaacctgcaggtggcagtgctctgagccatggccaccagcctggggccagggtgcaggtggacccaatgatgccacagggcagcgaggccagacaattggccagggcacccacccttcatcacctctgctcagaaccagctcccacctcactggggcaggggcaggggtgggtcaggtgtggagctggacctgggaccgcccacaagacaccctgatttggggcatgtagaggaagggctctgcaggcaagctcacctccccagcgcagccctccttctgcatgtatttgcgcacaatcgaccatatctggcacttggtgagcagctgccccccagtggcagcctcaaagtgttcataggttccaaacttctccagaacagcctcaatgatgccaactgcctgtacacggggccacagtggctggtcaggacaagccccttgggtggtcagggccaggatacggtggggaggctggactgacctgatggatgaactgtccagaggcctcgcagtacttttccagcacagccgtgggcatgggctcctggtactcaaactgtggattgtaggtgtaatgggactggaagaacttgtctcgctcacggtccatgttggttggccgcagggccaccaacatgcaggggctcttgctggcaatatggcctgcatccctttgagtcttagcaatgtgaggcagggaggctgcaggccgcagggtgcccccacctgggttccgtccccgtccaggtggaggccgtcccagggtgccacgcccccgccggccagtactatttacagagtaggtgctctcactgcgacgcatgtggccacggtggcccaggagcatctgtgagaacggctgctgctcaggctggggctgcagcgctggggggactgccagagccaggggcaaggccagggactgagaccaggggtacagtggtggcccatctcggtctgagggcttcagcctatggcgcagggatgggggactggtaggcgggctggggggtgcctgatcatacgcctgagcccctgagtccagcaccattctgtcctgggggtcacatccagccgggtcactccaactccccacactgtcgacctctggggacacagaagggcatgtggagaccagcatgagtgggtgtgaccaaacgaccagcaggccctgtactccacattgcctctgctgggcccttggtgggcccaggctctgctaccaggggtctgattggctgcagcgtccattgcctccagcagactcacccaaatatgctgggccggaagaaagcacttttgttttcgtttttgttttttgagacagggtctcactctgttgcccaaggtggagtgcagtgcaatgatcatagctcattgcagcctccaactcctggcctgaagtgatcctcccgcctcagcctcccaaagtgctggaattaaatgcatgagccatcgcacccagccgaaagcaagagttttaaacacccacctaggtggtggttactggaatcctctcagcctgagctcctgaaggcaaggactgagccccttactcgtgattctaatctctgtgctcactcacttaatctgggaggtggtacagtgcagcttcagctgcctgggcagattaggtaggtgagaagacctcagggactgccttcagcctatggcatcttctcagtgccacccctgcccatccacctggctttacccatatcctcctgcctatttggcctcagtcagtttcaatgtttgagggccccatgcttacgccggtaccccccagaatgccctctctcctctgagccatctgttgaaatccaaattagaatctgcttttgggaagcagaaggaagcttcagcaaatccaagccaatctctggcttgtcccctatctgagggatctttccagtggtcatccaaagccagtgtcagggcgctcaccccgactctgttccaggactcagtccaatcccaaccctccccagagactacctggagaggctccagctgctgagctcccttgcctgctcagtgactcacttccagcatttctcctctctcctacatcatcaatctcttcctctctactggactctttccatcaggataaacacatgctgttacttctccatcttaaaaaacaaaacaaaaccctcactagaacccacactcctccagctacagccccgctgcatctccctccacttgctcctattgcagcacatacctcgagtcatctatacccagtctccagttccttttttcctgttctctcttaaattcactccaattagccttttgttcccagcactccatccaaattgatctgatcaaggtcaccaatgaccagcaatgaccttcatattgatcagcacccgatacagttaatcactacctcctggaggccaggcagggtggctcacgcctgtaatcccagcactttgggaggccgaggcgggcggatcacctgaggtcgggagttcgagaccagcctgaccaacatggagaaaccccgtctctactaaaatacaaaattagctgggcgtggtggcacatgcctgtaaccccagctactcgggaggctgaggtaggagaatcgcttgaacccgggaggcggagtttgcggtgagccaagattgtgccatggcactccagcctgggcaacaacagcgaaactccatctcaaaaaaaaaaaaaaaaaaaaaagtcactgcctcctggaaacatgctgtccacttggttttccaaacacagtcgaacttagttctcctcctaccttgctggtcatccctgtctccctgacctcttaatactgtaatgctccaggacttgcctatggaaacttctccatttacgttcactccctagatgttctcatccactcttgtggttttacatacattagctcagacttcttccataaactttagaccagtgttgccaatttcagtgcaatttgagatactgtctatttgcccaggctggtcttgaattcctggcctcaagcaatcttcccacctcagccttccaactagctggaaccacaggcacatgccatcatgtccatcttcactgcagtgtcatcacttgaatgtttaataggcatatcaaacagaatatgtcctctgtctgggatgttcctccccctgtataatggcatgggtcactctctcactttcctcaaatctctgcatcaataccatgttattagaaaagcctaacacaccctcaataaaatagtaaacctcctctcccctctccactatctccccttccccaaattattgttctttgtagcagtcatcaccatctggagtgtacttcagtacagtttatatttgtatgataggtatatttgatagttatctgttttatcttttccaacattcacagctgtgtccccagaacccagaacagtgcctggcccgcagcaattgctcaataaataaatgaatccaagagctcttctttcagaactagaattattccttccctgcactttgcttccctatctagacttcatcttccccctctccactcctctctaccctgcctaatgaccagctgcttgaaaagacttcaggtcccaggcttcactccctttaactaactgtacagttttttggactcctcacccctttacaggtttctgcttggcccagtcccctccatctccccttctttcattcgacatacctcctcgaaattaccagaatacgcctgtttttttcacgtctcgggtccttccgccaagaatgcctttgcaatatattcctggagcaaactcttaaccattcttcaaggctcagtttaggcctcacttcctccaggaagccttccccgcgtctagtgtcccactgcttcggcgacttctttactcagagctgtcactgttggagtctaggtccgtgtcctcccacaatcccctgaactccccgaaggcaggaatggggtctgattcacccccgtgtaccaagcacccagcactgggtgcataatgaatgaaggatggatgggggaggagccccccactattaaggcggggtctagtgacaaatgagagggtgtggcctgtgcggagagaagccccggagaggacaaggtgaagagccaatggggaaccagaaatagaggaggggcgtgacctgcagccaataagtggtgggggataaggtgaagggcgtgcccaatggagggtggggccaggagacaatggagtggaggcttctccgggagatcaggaaaggtcgcgtcgcgcgcctcctcccggcctttgggggggtccgtccgcgtgccgtgcccccacctgttagctcctctgctcgccgcccgccgctcccgctctgctacaccggccaccggacgcccagccggcgggagccgtcgccgatgacgtacgtcctcgggcgcgcgcacgctcttacgaaagcgtggggcttcgcgtcagtctccgcggcggcgcgcccccgaggccactgggagcgaagccaggcagggttgagggggcggtgttcgtggtcctgggcccgcccccttcccaaggccacagcgagttgctgggcttcaggggctccaggcggccagggcggcggagactcttgctcacggcctgggcgcggagacgtgggggcgtagcccgcggcctcgggaacgcagtctgcacagagggcagatgcctgcataggcggggcgcagcccgtgtaccaggacgggagccaggatactttaagcgtgtcactctgcaag

What is claimed is:

1. A method, comprising:
   (a) obtaining a sample of an esophageal tissue from a subject,
   wherein the sample of the esophageal tissue comprises or is suspected of comprising a translocation, wherein the translocation is indicative of a predisposition to development of esophageal adenocarcinoma (EA) or presence of EA,
   wherein the translocation comprises:
      a break of chr16 with a fusion of the break of chr16 with chr2; and
   (b) detecting in the sample of esophageal tissue whether the translocation is present, by contacting the sample of esophageal tissue with at least one detectably labeled probe selected from: SEQ ID NO:1, SEQ ID NO:2, or combinations thereof, and at least one detectably labeled probe selected from: SEQ ID NO:6, SEQ ID NO:7, SEQ ID NO:8, or combination thereof.

2. The method of claim 1, wherein the sample of the esophageal tissue is fresh, frozen, or paraffin embedded.

3. The method of claim 1, wherein the subject has gastroesophageal reflux disease.

4. The method of claim 1, wherein the subject has Barrett's esophagus.

5. The method of claim 1, wherein the subject has low grade dysplasia.

6. The method of claim 1, wherein the subject has high grade dysplasia.

7. The method of claim 1, wherein the detecting is performed using a microscope or flow cytometry.

8. The method of claim 1, wherein the detectably labeled probe is detectable by fluorescence.

* * * * *